(12) United States Patent
Stege et al.

(10) Patent No.: US 9,096,871 B2
(45) Date of Patent: Aug. 4, 2015

(54) VARIANT CBH I POLYPEPTIDES WITH REDUCED PRODUCT INHIBITION

(75) Inventors: Justin T. Stege, San Diego, CA (US); Alexander Varvak, Netanya (IL); John Poland, San Diego, CA (US); Chris S. Lyon, San Diego, CA (US); Shaun Healey, San Diego, CA (US); Peter Luginbuhl, San Diego, CA (US)

(73) Assignee: BP Corporation North America Inc., Houston, TX (US)

( * ) Notice: Subject to any disclaimer, the term of this patent is extended or adjusted under 35 U.S.C. 154(b) by 158 days.

(21) Appl. No.: 13/824,317

(22) PCT Filed: Oct. 6, 2011

(86) PCT No.: PCT/US2011/055181
§ 371 (c)(1),
(2), (4) Date: Dec. 18, 2013

(87) PCT Pub. No.: WO2012/048171
PCT Pub. Date: Apr. 12, 2012

(65) Prior Publication Data
US 2014/0147894 A1 May 29, 2014

Related U.S. Application Data

(60) Provisional application No. 61/390,392, filed on Oct. 6, 2010.

(51) Int. Cl.
C12N 9/42 (2006.01)
C12P 7/14 (2006.01)
C12P 19/02 (2006.01)
C12P 19/14 (2006.01)

(52) U.S. Cl.
CPC ............ *C12P 7/14* (2013.01); *C12N 9/2437* (2013.01); *C12P 19/02* (2013.01); *C12P 19/14* (2013.01); *C12Y 302/01091* (2013.01); *Y02E 50/16* (2013.01); *Y02E 50/17* (2013.01)

(58) Field of Classification Search
None
See application file for complete search history.

(56) References Cited

U.S. PATENT DOCUMENTS

| 8,101,393 B2 * | 1/2012 | Gray et al. ............ 435/209 |
| 2009/0162916 A1 | 6/2009 | Adney | |

FOREIGN PATENT DOCUMENTS

| EP | 2357227 | 8/2011 |
| WO | WO 2004/078919 | 9/2004 |

* cited by examiner

*Primary Examiner* — Nashaat Nashed
(74) *Attorney, Agent, or Firm* — DLA Piper LLP (US)

(57) ABSTRACT

The present disclosure relates to variant CBH I polypeptides that have reduced product inhibition, and compositions, e.g., cellulase compositions, comprising variant CBH I polypeptides. The variant CBH I polypeptides and related compositions can be used in variety of agricultural and industrial applications. The present disclosure further relates to nucleic acids encoding variant CBH I polypeptides and host cells that recombinantly express the variant CBH I polypeptides.

57 Claims, 3 Drawing Sheets

Figure 1A:
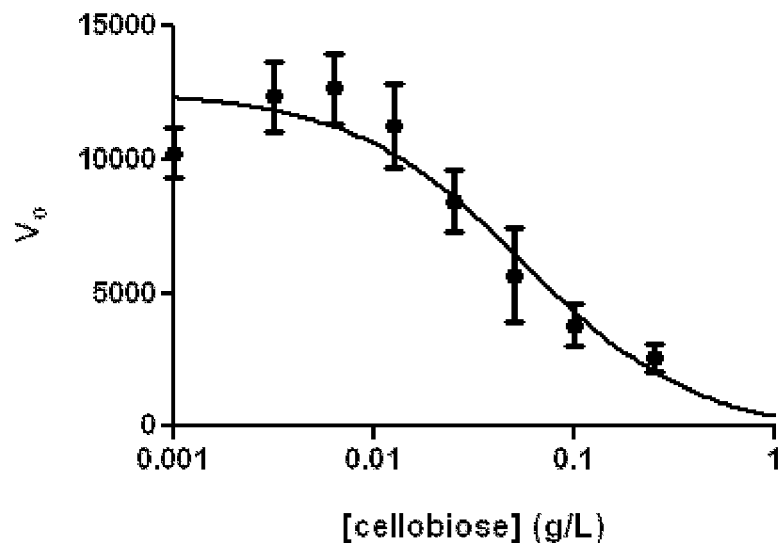

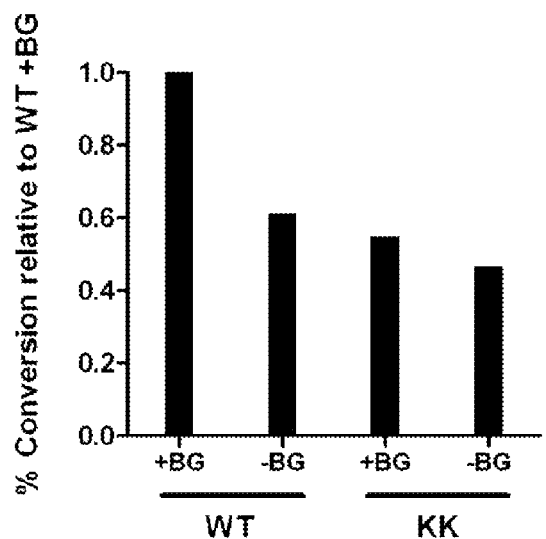
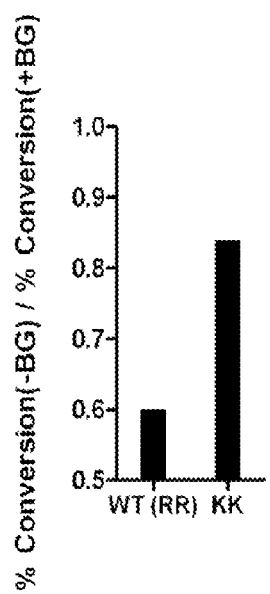
FIGURE 2A-2B
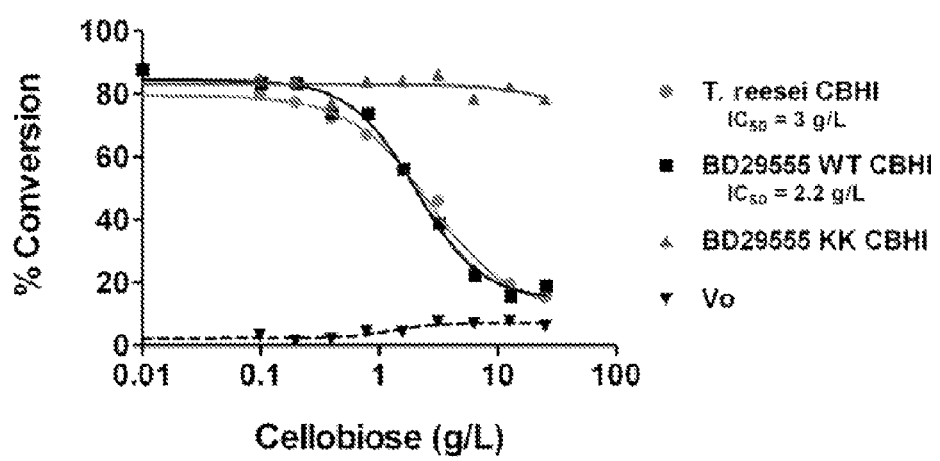
FIGURE 3

VARIANT CBH I POLYPEPTIDES WITH REDUCED PRODUCT INHIBITION

CROSS-REFERENCE TO RELATED APPLICATIONS

The present application claims the benefit of national stage application filed in compliance with 35 U.S.C. §371 of International Application No. PCT/US2011/055181, filed Oct. 6, 2011, which claims benefit under 35 U.S.C. §119(3) of U.S. Provisional Application No. 61/390,392, filed Oct. 6, 2010, and are herein incorporated in their entireties for all purposes.

BACKGROUND

Cellulose is an unbranched polymer of glucose linked by $\beta(1\rightarrow 4)$-glycosidic bonds. Cellulose chains can interact with each other via hydrogen bonding to form a crystalline solid of high mechanical strength and chemical stability. The cellulose chains are depolymerized into glucose and short oligosaccharides before organisms, such as the fermenting microbes used in ethanol production, can use them as metabolic fuel. Cellulase enzymes catalyze the hydrolysis of the cellulose (hydrolysis of $\beta$-1,4-D-glucan linkages) in the biomass into products such as glucose, cellobiose, and other cellooligosaccharides. Cellulase is a generic term denoting a multienzyme mixture comprising exo-acting cellobiohydrolases (CBHs), endoglucanases (EGs) and $\beta$-glucosidases (BGs) that can be produced by a number of plants and microorganisms. Enzymes in the cellulase of *Trichoderma reesei* include CBH1 (more generally, Cel7A), CBH2 (Cel6A), EG1 (Cel7B), EG2 (Cel5), EG3 (Cel12), EG4 (Cel61A), EG5 (Cel45A), EG6 (Cel74A), Cip1, Cip2, $\beta$-glucosidases (including, e.g., Cel3A), acetyl xylan esterase, $\beta$-mannanase, and swollenin.

Cellulase enzymes work synergistically to hydrolyze cellulose to glucose. CBH I and CBH II act on opposing ends of cellulose chains (Barr et al., 1996, Biochemistry 35:586-92), while the endoglucanases act at internal locations in the cellulose. The primary product of these enzymes is cellobiose, which is further hydrolyzed to glucose by one or more $\beta$-glucosidases.

The cellobiohydrolases are subject to inhibition by their direct product, cellobiose, which results in a slowing down of saccharification reactions as product accumulates. There is a need for new and improved cellobiohyrolases with improved productivity that maintain their reaction rates during the course of a saccharification reaction, for use in the conversion of cellulose into fermentable sugars and for related fields of cellulosic material processing such as pulp and paper, textiles and animal feeds.

SUMMARY

The present disclosure relates to variant CBH 1 polypeptides. Most naturally occurring CBH 1 polypeptides have arginines at positions corresponding to R268 and R411 of *T. reesei* CBH I (SEQ ID NO:2). The variant CBH I polypeptides of the present disclosure include a substitution at either or both positions resulting in a reduction or decrease in product (e.g., cellobiose) inhibition. Such variants are sometimes referred to herein as "product tolerant."

The variant CBH I polypeptides of the disclosure minimally contain at least a CBH I catalytic domain, comprising (a) a substitution at the amino acid position corresponding to R268 of *T. reesei* CBH I ("R268 substitution"); (b) a substitution at the amino acid position corresponding to R411 of *T. reesei* CBH I ("R411 substitution"); or (c) both an R268 substitution and an R411 substitution. The amino acid positions of exemplary CBH I polypeptides into which R268 and/or R411 substitutions can be introduced are shown in Table 1, and the amino acid positions corresponding to 8268 and/or R411 in these exemplary CBH I polypeptides are shown in Table 2.

R268 and/or R411 substituents can include lysines and/or alanines. Accordingly, the present disclosure provides a variant CBH I polypeptide comprising a CBH I catalytic domain with one of the following amino acid substitutions or pairs of R268 and/or R411 substitutions: (a) R268K and R411K; (b) R268K and R411A; (c) R268A and R411K; (d) R268A and R411A; (e) R268A; (0 R268K; (g) R411A; and (h) R411K. In some embodiments, however, the amino acid sequence of the variant CBH I polypeptide does not comprise or consist of SEQ ID NO:299, SEQ ID NO:300, SEQ ID NO:301, or SEQ ID NO:302.

The variant CBHI polypeptides of the disclosure typically include a CD comprising an amino acid sequence having at least 50% sequence identity to a CD of a reference CBH I exemplified in Table 1. The CD portions of the CBH I polypeptides exemplified in Table 1 are delineated in Table 3. The variant CBH I polypeptides can have a cellulose binding exemplified in Table 1. The CD portions of the CBH I polypeptides exemplified in Table 1 are delineated in Table 3. The variant CBH I polypeptides can have a cellulose binding domain ("CBD") sequence in addition to the catalytic domain ("CD") sequence. The CBD can be N- or C-terminal to the CD, and the CBD and CD are optionally connected via a linker sequence.

The variant CBH I polypeptides can be mature polypeptides or they may further comprise a signal sequence.

Additional embodiments of the variant CBH I polypeptides are provided in Section 5.1.

The variant CBH I polypeptides of the disclosure typically exhibit reduced product inhibition by cellobiose. In certain embodiments, the $IC_{50}$ of cellobiose towards a variant CBH I polypeptide of the disclosure is at least 1.2-fold, at least 1.5-fold, or at least 2-fold the $IC_{50}$ of cellobiose towards a reference CBH I lacking the R268 substitution and/or R411 substitution present in the variant. Additional embodiments of the product inhibition characteristics of the variant CBH I polypeptides are provided in Section 5.1.

The variant CBH I polypeptides of the disclosure typically retain some cellobiohydrolase activity. In certain embodiments, a variant CBH I polypeptide retains at least 50% the CBH I activity of a reference CBH I lacking the R268 substitution and/or R411 substitution present in the variant. Additional embodiments of cellobiohydrolase activity of the variant CBH I polypeptides are provided in Section 5.1.

The present disclosure further provides compositions (including cellulase compositions, e.g., whole cellulase compositions, and fermentation broths) comprising variant CBH I polypeptides. Additional embodiments of compositions comprising variant CBH I polypeptides are provided in Section 5.3. The variant CBH I polypeptides and compositions comprising them can be used, inter alia, in processes for saccharifying biomass. Additional details of saccharification reactions, and additional applications of the variant CBH I polypeptides, are provided in Section 5.4.

The present disclosure further provides nucleic acids (e.g., vectors) comprising nucleotide sequences encoding variant CBH I polypeptides as described herein, and recombinant cells engineered to express the variant CBH I polypeptides. The recombinant cell can be a prokaryotic (e.g., bacterial) or eukaryotic (e.g., yeast or filamentous fungal) cell. Further provided are methods of producing and optionally recovering the variant CBH I polypeptides. Additional embodiments of the recombinant expression system suitable for expression and production of the variant CBH I polypeptides are provided in Section 5.2.

BRIEF DESCRIPTION OF THE FIGURES AND TABLES

Figure 1B:
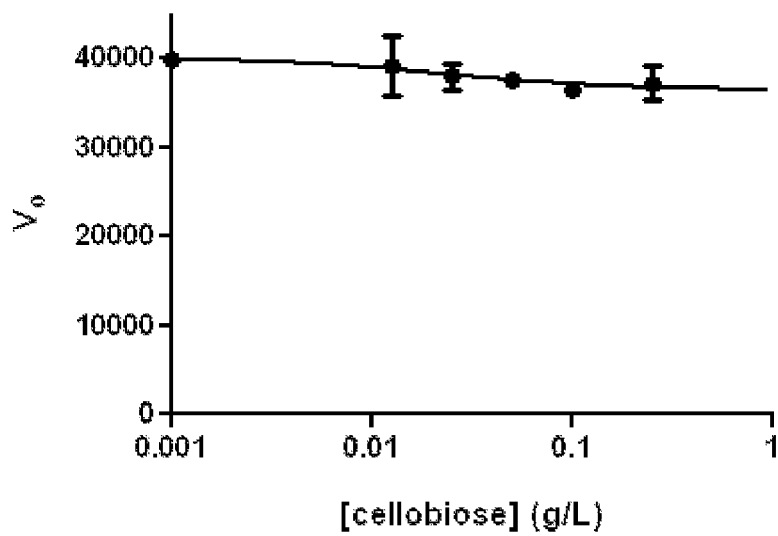

FIG. 1A-1B: Cellobiose dose-response curves using a 4-MUL assay for a wild-type CBH I (BD29555; FIG. 1A) and a R268K/R411K variant CBH I (BD29555 with the substitutions R273K/R422K; FIG. 1B).

FIG. 2A-2B: The effect of cellobiose accumulation on the activity of wild-type CBH I and a R268K/R411K variant CBH I, based on percent conversion of glucan after 72 hours in the bagasse assay. FIG. 2A shows relative activity in the presence (+) and absence (−) of β-glucosidase (BG), where relative activity is normalized to wild type activity with BG (WT+=1). FIG. 2B shows tolerance to cellobiose as a function of the ratio of activity in the absence vs. presence of β-glucosidase (activity ratio=Activity−BG/Activity+BG).

FIG. 3: Cellobiose dose-response curves using PASC assay for a R268K/R411K variant CBH I polypeptide as compared to two wild type CBH I polypeptides.

Figure 4:
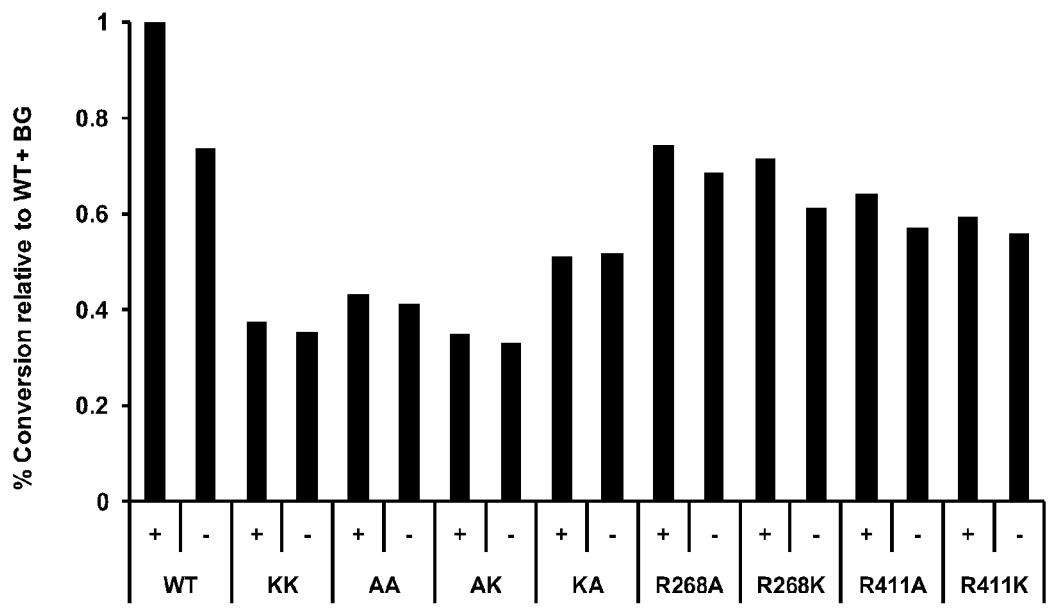

FIG. 4: The effect of cellobiose accumulation on the activity of a wild-type CBH I and a R268K/R411K variant CBH I based on percent conversion of glucan after 72 hours in the bagasse assay in the presence (+) and absence (−) of β-glucosidase (BG). Activity is normalized to wild type activity with BG (WT+=1).

Figure 5:
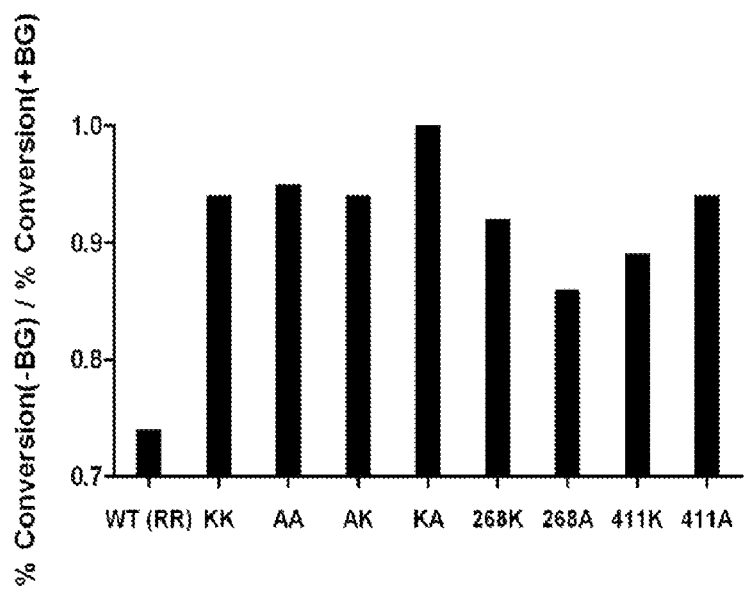

FIG. 5: Characterization of cellobiose product tolerance of variant CBH I polypeptides, based on percent conversion of glucan after 72 hours in the absence and presence of β-glucosidase (BG) in the bagasse assay; tolerance is evaluated as a function of the ratio of activity in the absence vs. presence of β-glucosidase.

TABLE 1: Amino acid sequences of exemplary "reference" CBH I polypeptides that can be modified at positions corresponding to R268 and/or R411 in *T. reesei* CBH I (SEQ ID NO:2). The database accession numbers are indicated in the second column. Unless indicated otherwise, the accession numbers refer to the Genbank database. "#" indicates that the CBH I has no signal peptide; "&" indicate that the sequence is from the PDB database and represents the catalytic domain only without signal sequence; * indicates a nonpublic database. These amino acid sequences are mostly wild type, with the exception of some sequences from the PDB database which contain mutations to facilitate protein crystallization.

TABLE 2: Amino acid positions in the exemplary reference CBH I polypeptides that correspond to R268 and R411 in *T. reesei* CBH I. Database descriptors are as for Table 1.

TABLE 3: Approximate amino acid positions of CBH I polypeptide domains. Abbreviations used: SS is signal sequence; CD is catalytic domain; and CBD is cellulose binding domain. Database descriptors are as for Table 1.

TABLE 4: Table 4 shows a segment within the catalytic domain of each exemplary reference CBH I polypeptide containing the active site loop (shown in bold, underlined text) and the catalytic residues (glutamates in most CBH I polypeptides) (shown in bold, double underlined text). Database descriptors are as for Table 1.

TABLE 5: MUL and bagasse assay results for variants of BD29555. ND means not determined. ±% Activity (+/−cellobiose)=[(Activity with cellobiose)/(Activity without cellobiose)]*100. ¥% Activity (−/+BG)=[(Activity without BG)/(Activity with BG)]*100]

TABLE 6: MUL and bagasse assay results for variants of *T. reesei* CBH I. ND means not determined. ±% Activity (+/−cellobiose)=[(Activity with cellobiose)/(Activity without cellobiose)]*100. ¥% Activity (−/+BG)=[(Activity without BG)/(Activity with BG)]*100.

TABLE 7: Informal sequence listing. SEQ ID NO:1-149 correspond to the exemplary reference CBH I polypeptides. SEQ ID NO:299 corresponds to mature *T. reesei* CBH I (amino acids 26-529 of SEQ ID NO:2) with an R268A substitution. SEQ ID NO:300 corresponds to mature *T. reesei* CBH I (amino acids 26-529 of SEQ ID NO:2) with an R411A substitution. SEQ ID NO:301 corresponds to full length BD29555 with both an R268K substitution and an R411K substitution. SEQ ID NO:302 corresponds to mature BD29555 with both an R268K substitution and an R411K substitution. corresponds to mature *T. reesei* CBH I (amino acids 26-529 of SEQ ID NO:2) with an R411A substitution. SEQ ID NO:152 corresponds to full length BD29555 with both an R268K substitution and an R411K substitution. SEQ ID NO:153 corresponds to mature BD29555 with both an R268K substitution and an R411K substitution.

DETAILED DESCRIPTION

The present disclosure relates to variant CBH I polypeptides. Most naturally occurring CBH I polypeptides have arginines at positions corresponding to R268 and R411 of *T. reesei* CBH I (SEQ ID NO:2). The variant CBH I polypeptides of the present disclosure include a substitution at either or both positions resulting in a reduction of product (e.g., cellobiose) inhibition. The following subsections describe in greater detail the variant CBH I polypeptides and exemplary methods of their production, exemplary cellulase compositions comprising them, and some industrial applications of the polypeptides and cellulase compositions.

Variant CBH I Polypeptides

The present disclosure provides variant CBH I polypeptides comprising at least one amino acid substitution that results in reduced product inhibition. "Variant" means a polypeptide which is differs in sequence from a reference polypeptide by substitution of one or more amino acids at one or a number of different sites in the amino acid sequence. Exemplary reference CBH I polypeptides are shown in Table 1.

The variant CBH I polypeptides of the disclosure have an amino acid substitution at the amino acid position corresponding to R268 of *T. reesei* CBH I (SEQ ID NO:2) (an "R268 substitution"), (b) a substitution at the amino acid position corresponding to R411 of *T. reesei* CBH I ("R411 substitution"); or (c) both an R268 substitution and an R411 substitution, as compared to a reference CBH I polypeptide. It is noted that the R268 and R411 numbering is made by reference to the full length *T. reesei* CBH I, which includes a signal sequence that is generally absent from the mature enzyme. The corresponding numbering in the mature *T. reesei* CBH I (see, e.g., SEQ ID NO:4) is R251 and R394, respectively.

Accordingly, the present disclosure provides variant CBH I polypeptides in which at least one of the amino acid positions corresponding to R268 and R411 of *T. reesei* CBH I, and optionally both the amino acid positions corresponding to R268 and R411 of *T. reesei* CBH I, is not an arginine.

The amino acid positions in the reference polypeptides of Table 1 that correspond to R268 and R411 in *T. reesei* CBH I are shown in Table 2. Amino acid positions in other CBH I polypeptides that correspond to R268 and R411 can be identified through alignment of their sequences with *T. reesei*

CBH I using a sequence comparison algorithm. Optimal alignment of sequences for comparison can be conducted, e.g., by the local homology algorithm of Smith & Waterman, 1981, Adv. Appl. Math. 2:482-89; by the homology alignment algorithm of Needleman & Wunsch, 1970, J. Mol. Biol. 48:443-53; by the search for similarity method of Pearson & Lipman, 1988, Proc. Nat'l Acad. Sci. USA 85:2444-48, by computerized implementations of these algorithms (GAP, BESTFIT, FASTA, and TFASTA in the Wisconsin Genetics Software Package, Genetics Computer Group, 575 Science Dr, Madison, Wis.), or by visual inspection.

The R268 and/or R411 substitutions are preferably selected from (a) R268K and R411K; (b) R268K and R411A; (c) R268A and/R411K; (d) R268A and R411A; (e) R268A; (f) R268K; (g) R411A; and (h) R411K.

CBH I polypeptides belong to the glycosyl hydrolase family 7 ("GH7"). The glycosyl hydrolases of this family include endoglucanases and cellobiohydrolases (exoglucanases). The cellobiohydrolases act processively from the reducing ends of cellulose chains to generate cellobiose. Cellulases of bacterial and fungal origin characteristically have a small cellulose-binding domain ("CBD") connected to either the N or the C terminus of the catalytic domain ("CD") via a linker peptide (see Suumakki et al., 2000, Cellulose 7: 189-209). The CD contains the active site whereas the CBD interacts with cellulose by binding the enzyme to it (van Tilbeurgh et al., 1986, FEBS Lett. 204(2): 223-227; Tomme et al., 1988, Eur. J. Biochem. 170:575-581). The three-dimensional structure of the catalytic domain of T. reesei CBH I has been solved (Divne et al., 1994, Science 265:524-528). The CD consists of two β-sheets that pack face-to-face to form a β-sandwich. Most of the remaining amino acids in the CD are loops connecting the β-sheets. Some loops are elongated and bend around the active site, forming cellulose-binding tunnel of (~50 Å). In contrast, endoglucanases have an open substrate binding cleft/groove rather than a tunnel. Typically, the catalytic residues are glutamic acids corresponding to E229 and E234 of T. reesei CBH I.

The loops characteristic of the active sites ("the active site loops") of reference CBH I polypeptides, which are absent from GH7 family endoglucanases, as well as catalytic glutamate residues of the reference CBH I polypeptides, are shown in Table 4. The variant CBH I polypeptides of the disclosure preferably retain the catalytic glutamate residues or may include a glutamine instead at the position corresponding to E234, as for SEQ ID NO:4. In some embodiments, the variant CBH I polypeptides contain no substitutions or only conservative substitutions in the active site loops relative to the reference CBH I polypeptides from which the variants are derived.

Many CBH I polypeptides do not have a CBD, and most studies concerning the activity of cellulase domains on different substrates have been carried out with only the catalytic domains of CBH I polypeptides. Because CDs with cellobiohydrolase activity can be generated by limited proteolysis of mature CBH I by papain (see, e.g., Chen et al., 1993, Biochem. Mol. Biol. Int. 30(5):901-10), they are often referred to as "core" domains. Accordingly, a variant CBH I can include only the CD "core" of CBH I. Exemplary reference CDs comprise amino acid sequences corresponding to positions 26 to 455 of SEQ ID NO:1, positions 18 to 444 of SEQ ID NO:2, positions 26 to 455 of SEQ ID NO:3, positions 1 to 427 of SEQ ID NO:4, positions 24 to 457 of SEQ ID NO:5, positions 18 to 448 of SEQ ID NO:6, positions 27 to 460 of SEQ ID NO:7, positions 27 to 460 of SEQ ID NO:8, positions 20 to 449 of SEQ ID NO:9, positions 1 to 424 of SEQ ID NO:10, positions 18 to 447 of SEQ ID NO:11, positions 18 to 434 of SEQ ID NO:12, positions 18 to 445 of SEQ ID NO:13, positions 19 to 454 of SEQ ID NO:14, positions 19 to 443 of SEQ ID NO:15, positions 2 to 426 of SEQ ID NO:16, positions 23 to 446 of SEQ ID NO:17, positions 19 to 449 of SEQ ID NO:18, positions 23 to 446 of SEQ ID NO:19, positions 19 to 449 of SEQ ID NO:20, positions 2 to 416 of SEQ ID NO:21, positions 19 to 454 of SEQ ID NO:22, positions 19 to 447 of SEQ ID NO:23, positions 19 to 447 of SEQ ID NO:24, positions 20 to 443 of SEQ ID NO:25, positions 18 to 447 of SEQ ID NO:26, positions 19 to 442 of SEQ ID NO:27, positions 18 to 451 of SEQ ID NO:28, positions 23 to 446 of SEQ ID NO:29, positions 18 to 444 of SEQ ID NO:30, positions 18 to 451 of SEQ ID NO:31, positions 18 to 447 of SEQ ID NO:32, positions 19 to 449 of SEQ ID NO:33, positions 18 to 447 of SEQ ID NO:34, positions 26 to 459 of SEQ ID NO:35, positions 19 to 450 of SEQ ID NO:36, positions 19 to 453 of SEQ ID NO:37, positions 18 to 448 of SEQ ID NO:38, positions 19 to 443 of SEQ ID NO:39, positions 19 to 442 of SEQ ID NO:40, positions 18 to 444 of SEQ ID NO:41, positions 24 to 457 of SEQ ID NO:42, positions 18 to 449 of SEQ ID NO:43, positions 19 to 453 of SEQ ID NO:44, positions 26 to 456 of SEQ ID NO:45, positions 19 to 451 of SEQ ID NO:46, positions 18 to 443 of SEQ ID NO:47, positions 18 to 448 of SEQ ID NO:48, positions 19 to 451 of SEQ ID NO:49, positions 18 to 444 of SEQ ID NO:50, positions 2 to 419 of SEQ ID NO:51, positions 27 to 461 of SEQ ID NO:52, positions 21 to 445 of SEQ ID NO:53, positions 19 to 449 of SEQ ID NO:54, positions 19 to 448 of SEQ ID NO:55, positions 18 to 443 of SEQ ID NO:56, positions 20 to 443 of SEQ ID NO:57, positions 18 to 448 of SEQ ID NO:58, positions 18 to 447 of SEQ ID NO:59, positions 26 to 455 of SEQ ID NO:60, positions 19 to 449 of SEQ ID NO:61, positions 19 to 449 of SEQ ID NO:62, positions 26 to 460 of SEQ ID NO:63, positions 18 to 448 of SEQ ID NO:64, positions 19 to 451 of SEQ ID NO:65, positions 19 to 447 of SEQ ID NO:66, positions 1 to 424 of SEQ ID NO:67, positions 19 to 448 of SEQ ID NO:68, positions 19 to 443 of SEQ ID NO:69, positions 23 to 447 of SEQ ID NO:70, positions 17 to 448 of SEQ ID NO:71, positions 19 to 449 of SEQ ID NO:72, positions 18 to 444 of SEQ ID NO:73, positions 23 to 458 of SEQ ID NO:74, positions 20 to 452 of SEQ ID NO:75, positions 18 to 435 of SEQ ID NO:76, positions 18 to 446 of SEQ ID NO:77, positions 22 to 457 of SEQ ID NO:78, positions 18 to 448 of SEQ ID NO:79, positions 1 to 431 of SEQ ID NO:80, positions 19 to 453 of SEQ ID NO:81, positions 21 to 440 of SEQ ID NO:82, positions 19 to 442 of SEQ ID NO:83, positions 18 to 448 of SEQ ID NO:84, positions 17 to 446 of SEQ ID NO:85, positions 18 to 447 of SEQ ID NO:86, positions 18 to 443 of SEQ ID NO:87, positions 23 to 448 of SEQ ID NO:88, positions 18 to 451 of SEQ ID NO:89, positions 21 to 447 of SEQ ID NO:90, positions 18 to 444 of SEQ ID NO:91, positions 19 to 442 of SEQ ID NO:92, positions 20 to 436 of SEQ ID NO:93, positions 18 to 450 of SEQ ID NO:94, positions 22 to 453 of SEQ ID NO:95, positions 16 to 472 of SEQ ID NO:96, positions 21 to 445 of SEQ ID NO:97, positions 19 to 447 of SEQ ID NO:98, positions 19 to 450 of SEQ ID NO:99, positions 19 to 451 of SEQ ID NO:100, positions 18 to 448 of SEQ ID NO:101, positions 19 to 442 of SEQ ID NO:102, positions 20 to 457 of SEQ ID NO:103, positions 19 to 454 of SEQ ID NO:104, positions 18 to 440 of SEQ ID NO:105, positions 18 to 439 of SEQ ID NO:106, positions 27 to 460 of SEQ ID NO:107, positions 23 to 446 of SEQ ID NO:108, positions 17 to 446 of SEQ ID NO:109, positions 21 to 447 of SEQ ID NO:110, positions 19 to 447 of SEQ ID NO:111, positions 18 to 449 of SEQ ID NO:112, positions 22 to 457 of SEQ ID NO:113, positions 18 to 445 of SEQ ID NO:114, positions 18 to 448 of SEQ ID NO:115, positions 18 to 448 of SEQ ID NO:116, positions 23 to 435 of SEQ ID NO:117, positions 21 to 442 of SEQ ID NO:118, positions 23 to 435 of SEQ ID NO:119, positions 20 to 445 of SEQ ID NO:120, positions 21 to 443 of SEQ ID NO:121, positions 20 to 445 of SEQ ID NO:122, positions 23 to 443 of SEQ ID NO:123, positions 20 to 445 of SEQ ID NO:124, positions 21 to 435 of SEQ ID NO:125, positions 20 to 437 of SEQ ID NO:126, positions 21 to 442 of SEQ ID NO:127, positions 23 to 434 of SEQ ID NO:128, positions 20 to 444 of SEQ ID NO:129, positions 21 to 435 of SEQ ID NO:130, positions 20 to 445 of SEQ ID NO:131, positions 21 to 446 of SEQ ID NO:132, positions 21 to 435 of SEQ ID NO:133, positions 22 to 448 of SEQ ID NO:134, positions 23 to 433 of SEQ ID NO:135, positions 23 to 434 of SEQ ID NO:136, positions 23 to 435 of SEQ ID NO:137, positions 23 to 435 of SEQ ID NO:138, positions 20 to 445 of SEQ ID NO:139, positions 20 to 437 of SEQ ID NO:140, positions 21 to 435 of SEQ ID NO:141, positions 20 to 437 of SEQ ID NO:142, positions 21 to 435 of SEQ ID NO:143, positions 26 to 435 of SEQ ID NO:144, positions 23 to 435 of SEQ ID NO:145, positions 24 to 443 of SEQ ID NO:146, positions 20 to 445 of SEQ ID NO:147, positions 21 to 441 of SEQ ID NO:148, and positions 20 to 437 of SEQ ID NO:149.

The CBDs are particularly involved in the hydrolysis of crystalline cellulose. It has been shown that the ability of cellobiohydrolases to degrade crystalline cellulose decreases when the CBD is absent (Linder and Teeri, 1997, Journal of Biotechnol. 57:15-28). The variant CBH I polypeptides of the disclosure can further include a CBD. Exemplary CBDs comprise amino acid sequences corresponding to positions 494 to 529 of SEQ ID NO:1, positions 480 to 514 of SEQ ID NO:2, positions 494 to 529 of SEQ ID NO:3, positions 491 to 526 of SEQ ID NO:5, positions 477 to 512 of SEQ ID NO:6, positions 497 to 532 of SEQ ID NO:7, positions 504 to 539 of SEQ ID NO:8, positions 486 to 521 of SEQ ID NO:13, positions 556 to 596 of SEQ ID NO:15, positions 490 to 525 of SEQ ID NO:18, positions 495 to 530 of SEQ ID NO:20, positions 471 to 506 of SEQ ID NO:23, positions 481 to 516 of SEQ ID NO:27, positions 480 to 514 of SEQ ID NO:30, positions 495 to 529 of SEQ ID NO:35, positions 493 to 528 of SEQ ID NO:36, positions 477 to 512 of SEQ ID NO:38, positions 547 to 586 of SEQ ID NO:39, positions 475 to 510 of SEQ ID NO:40, positions 479 to 513 of SEQ ID NO:41, positions 506 to 541 of SEQ ID NO:42, positions 481 to 516 of SEQ ID NO:43, positions 503 to 537 of SEQ ID NO:45, positions 488 to 523 of SEQ ID NO:46, positions 476 to 511 of SEQ ID NO:48, positions 488 to 523 of SEQ ID NO:49, positions 479 to 513 of SEQ ID NO:50, positions 500 to 535 of SEQ ID NO:52, positions 493 to 528 of SEQ ID NO:55, positions 479 to 514 of SEQ ID NO:58, positions 494 to 529 of SEQ ID NO:60, positions 490 to 525 of SEQ ID NO:61, positions 497 to 532 of SEQ ID NO:62, positions 475 to 510 of SEQ ID NO:64, positions 477 to 512 of SEQ ID NO:65, positions 486 to 521 of SEQ ID NO:66, positions 470 to 505 of SEQ ID NO:67, positions 491 to 526 of SEQ ID NO:68, positions 476 to 511 of SEQ ID NO:69, positions 480 to 514 of SEQ ID NO:73, positions 506 to 540 of SEQ ID NO:74, positions 471 to 504 of SEQ ID NO:76, positions 501 to 536 of SEQ ID NO:78, positions 473 to 508 of SEQ ID NO:79, positions 481 to 516 of SEQ ID NO:83, positions 488 to 523 of SEQ ID NO:86, positions 475 to 510 of SEQ ID NO:92, positions 468 to 504 of SEQ ID NO:93, positions 501 to 536 of SEQ ID NO:96, positions 482 to 517 of SEQ ID NO:98, positions 481 to 516 of SEQ ID NO:99, positions 488 to 523 of SEQ ID NO:100, positions 472 to 507 of SEQ ID NO:101, positions 481 to 516 of SEQ ID NO:102, positions 471 to 505 of SEQ ID NO:105, positions 481 to 516 of SEQ ID NO:106, positions 495 to 530 of SEQ ID NO:107, positions 488 to 523 of SEQ ID NO:111, positions 478 to 513 of SEQ ID NO:112, positions 501 to 536 of SEQ ID NO:113, positions 491 to 526 of SEQ ID NO:115, and positions 503 to 538 of SEQ ID NO:116.

The CD and CBD are often connected via a linker. Exemplary linker sequences correspond to positions 456 to 493 of SEQ ID NO:1, positions 445 to 479 of SEQ ID NO:2, positions 456 to 493 of SEQ ID NO:3, positions 458 to 490 of SEQ ID NO:5, positions 449 to 476 of SEQ ID NO:6, positions 461 to 496 of SEQ ID NO:7, positions 461 to 503 of SEQ ID NO:8, positions 446 to 485 of SEQ ID NO:13, positions 444 to 555 of SEQ ID NO:15, positions 450 to 489 of SEQ ID NO:18, positions 450 to 494 of SEQ ID NO:20, positions 448 to 470 of SEQ ID NO:23, positions 443 to 480 of SEQ ID NO:27, positions 445 to 479 of SEQ ID NO:30, positions 460 to 494 of SEQ ID NO:35, positions 451 to 492 of SEQ ID NO:36, positions 449 to 476 of SEQ ID NO:38, positions 444 to 546 of SEQ ID NO:39, positions 443 to 474 of SEQ ID NO:40, positions 445 to 478 of SEQ ID NO:41, positions 458 to 505 of SEQ ID NO:42, positions 450 to 480 of SEQ ID NO:43, positions 457 to 502 of SEQ ID NO:45, positions 452 to 487 of SEQ ID NO:46, positions 449 to 475 of SEQ ID NO:48, positions 452 to 487 of SEQ ID NO:49, positions 445 to 478 of SEQ ID NO:50, positions 462 to 499 of SEQ ID NO:52, positions 449 to 492 of SEQ ID NO:55, positions 449 to 478 of SEQ ID NO:58, positions 456 to 493 of SEQ ID NO:60, positions 450 to 489 of SEQ ID NO:61, positions 450 to 496 of SEQ ID NO:62, positions 449 to 474 of SEQ ID NO:64, positions 452 to 476 of SEQ ID NO:65, positions 448 to 485 of SEQ ID NO:66, positions 425 to 469 of SEQ ID NO:67, positions 449 to 490 of SEQ ID NO:68, positions 444 to 475 of SEQ ID NO:69, positions 445 to 479 of SEQ ID NO:73, positions 459 to 505 of SEQ ID NO:74, positions 436 to 470 of SEQ ID NO:76, positions 458 to 500 of SEQ ID NO:78, positions 449 to 472 of SEQ ID NO:79, positions 443 to 480 of SEQ ID NO:83, positions 448 to 487 of SEQ ID NO:86, positions 443 to 474 of SEQ ID NO:92, positions 437 to 467 of SEQ ID NO:93, positions 473 to 500 of SEQ ID NO:96, positions 448 to 481 of SEQ ID NO:98, positions 451 to 480 of SEQ ID NO:99, positions 452 to 487 of SEQ ID NO:100, positions 449 to 471 of SEQ ID NO:101, positions 443 to 480 of SEQ ID NO:102, positions 441 to 470 of SEQ ID NO:105, positions 440 to 480 of SEQ ID NO:106, positions 461 to 494 of SEQ ID NO:107, positions 448 to 487 of SEQ ID NO:111, positions 450 to 478 of SEQ ID NO:112, positions 458 to 500 of SEQ ID NO:113, positions 449 to 490 of SEQ ID NO:115, and positions 449 to 502 of SEQ ID NO:116.

Because CBH I polypeptides are modular, the CBDs, CDs and linkers of different CBH I polypeptides, such as the exemplary CBH I polypeptides of Table 1, can be used interchangeably. However, in a preferred embodiment, the CBDs, CDs and linkers of a variant CBH I of the disclosure originate from the same polypeptide.

The variant CBH I polypeptides of the disclosure preferably have at least a two-fold reduction of product inhibition, such that cellobiose has an $IC_{50}$ towards the variant CBH I that is at least 2-fold the $IC_{50}$ of the corresponding reference CBH I, e.g., CBH I lacking the R268 substitution and/or R411 substitution. More preferably the $IC_{50}$ of cellobiose towards the variant CBH I is at least 3-fold, at least 5-fold, at least 8-fold, at least 10-fold, at least 12-fold or at least 15-fold the $IC_{50}$ of the corresponding reference CBH I. In specific embodiments the $IC_{50}$ of cellobiose towards the variant CBH I is ranges from 2-fold to 15-fold, from 2-fold to 10-fold, from 3-fold to 10-fold, from 5-fold to 12-fold, from 4-fold to 12-fold, from 5-fold to 10-fold, from 5-fold to 12-fold, from 2-fold to 8-fold, or from 8-fold to 20-fold the $IC_{50}$ of the corresponding reference CBH I. The $IC_{50}$ can be determined in a phosphoric acid swollen cellulose ("PASC") assay (Du et al., 2010, Applied Biochemistry and Biotechnology 161:313-317) or a methylumbelliferyl lactoside ("MUL") assay (van Tilbeurgh and Claeyssens, 1985, FEBS Letts. 187(2):283-288), as exemplified in the Examples below.

The variant CBH I polypeptides of the disclosure preferably have a cellobiohydrolase activity that is at least 30% the cellobiohydrolase activity of the corresponding reference CBH I, e.g., CBH I lacking the R268 substitution and/or R411 substitution. More preferably, the cellobiohydrolase activity of the variant CBH I is at least 40%, at least 50%, at least 60% or at least 70% the cellobiohydrolase activity of the corresponding reference CBH I. In specific embodiments the $IC_{50}$ cellobiohydrolase activity of the variant CBH I is ranges from 30% to 80%, from 40% to 70%, 30% to 60%, from 50% to 80% or from 60% to 80% of the cellobiohydrolase activity of the corresponding reference CBH I. Assays for cellobiohydrolase activity are described, for example, in Becker et al., 2011, Biochem J. 356:19-30 and Mitsuishi et al., 1990, FEBS Letts. 275:135-138, each of which is expressly incorporated by reference herein. The ability of CBH I to hydrolyze isolated soluble and insoluble substrates can also be measured using assays described in Srisodsuk et al., 1997, J. Biotech. 57:4957 and Nidetzky and Claeyssens, 1994, Biotech. Bioeng. 44:961-966. Substrates useful for assaying cellobiohydrolase activity include crystalline cellulose, filter paper, phosphoric acid swollen cellulose, cellooligosaccharides, methylumbelliferyl lactoside, methylumbelliferyl cellobioside, orthonitrophenyl lactoside, paranitrophenyl lactoside, orthonitrophenyl cellobioside, paranitrophenyl cellobioside. Cellobiohydrolase activity can be measured in an assay utilizing PASC as the substrate and a calcofluor white detection method (Du et al., 2010, Applied Biochemistry and Biotechnology 161:313-317). PASC can be prepared as described by Walseth, 1952, TAPPI 35:228-235 and Wood, 1971, Biochem. J. 121:353-362.

Other than said R268 and/or R411 substitution, the variant CBH I polypeptides of the disclosure preferably:

comprise an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a CD of a reference CBH I exemplified in Table 1 (i.e., a CD comprising an amino acid sequence corresponding to positions 26 to 455 of SEQ ID NO:1, positions 18 to 444 of SEQ ID NO:2, positions 26 to 455 of SEQ ID NO:3, positions 1 to 427 of SEQ ID NO:4, positions 24 to 457 of SEQ ID NO:5, positions 18 to 448 of SEQ ID NO:6, positions 27 to 460 of SEQ ID NO:7, positions 27 to 460 of SEQ ID NO:8, positions 20 to 449 of SEQ ID NO:9, positions 1 to 424 of SEQ ID NO:10, positions 18 to 447 of SEQ ID NO:11, positions 18 to 434 of SEQ ID NO:12, positions 18 to 445 of SEQ ID NO:13, positions 19 to 454 of SEQ ID NO:14, positions 19 to 443 of SEQ ID NO:15, positions 2 to 426 of SEQ ID NO:16, positions 23 to 446 of SEQ ID NO:17, positions 19 to 449 of SEQ ID NO:18, positions 23 to 446 of SEQ ID NO:19, positions 19 to 449 of SEQ ID NO:20, positions 2 to 416 of SEQ ID NO:21, positions 19 to 454 of SEQ ID NO:22, positions 19 to 447 of SEQ ID NO:23, positions 19 to 447 of SEQ ID NO:24, positions 20 to 443 of SEQ ID NO:25, positions 18 to 447 of SEQ ID NO:26, positions 19 to 442 of SEQ ID NO:27, positions 18 to 451 of SEQ ID NO:28, positions 23 to 446 of SEQ ID NO:29, positions 18 to 444 of SEQ ID NO:30, positions 18 to 451 of SEQ ID NO:31, positions 18 to 447 of SEQ ID NO:32, positions 19 to 449 of SEQ ID NO:33, positions 18 to 447 of SEQ ID NO:34, positions 26 to 459 of SEQ ID NO:35, positions 19 to 450 of SEQ ID NO:36, positions 19 to 453 of SEQ ID NO:37, positions 18 to 448 of SEQ ID NO:38, positions 19 to 443 of SEQ ID NO:39, positions 19 to 442 of SEQ ID NO:40, positions 18 to 444 of SEQ ID NO:41, positions 24 to 457 of SEQ ID NO:42, positions 18 to 449 of SEQ ID NO:43, positions 19 to 453 of SEQ ID NO:44, positions 26 to 456 of SEQ ID NO:45, positions 19 to 451 of SEQ ID NO:46, positions 18 to 443 of SEQ ID NO:47, positions 18 to 448 of SEQ ID NO:48, positions 19 to 451 of SEQ ID NO:49, positions 18 to 444 of SEQ ID NO:50, positions 2 to 419 of SEQ ID NO:51, positions 27 to 461 of SEQ ID NO:52, positions 21 to 445 of SEQ ID NO:53, positions 19 to 449 of SEQ ID NO:54, positions 19 to 448 of SEQ ID NO:55, positions 18 to 443 of SEQ ID NO:56, positions 20 to 443 of SEQ ID NO:57, positions 18 to 448 of SEQ ID NO:58, positions 18 to 447 of SEQ ID NO:59, positions 26 to 455 of SEQ ID NO:60, positions 19 to 449 of SEQ ID NO:61, positions 19 to 449 of SEQ ID NO:62, positions 26 to 460 of SEQ ID NO:63, positions 18 to 448 of SEQ ID NO:64, positions 19 to 451 of SEQ ID NO:65, positions 19 to 447 of SEQ ID NO:66, positions 1 to 424 of SEQ ID NO:67, positions 19 to 448 of SEQ ID NO:68, positions 19 to 443 of SEQ ID NO:69, positions 23 to 447 of SEQ ID NO:70, positions 17 to 448 of SEQ ID NO:71, positions 19 to 449 of SEQ ID NO:72, positions 18 to 444 of SEQ ID NO:73, positions 23 to 458 of SEQ ID NO:74, positions 20 to 452 of SEQ ID NO:75, positions 18 to 435 of SEQ ID NO:76, positions 18 to 446 of SEQ ID NO:77, positions 22 to 457 of SEQ ID NO:78, positions 18 to 448 of SEQ ID NO:79, positions 1 to 431 of SEQ ID NO:80, positions 19 to 453 of SEQ ID NO:81, positions 21 to 440 of SEQ ID NO:82, positions 19 to 442 of SEQ ID NO:83, positions 18 to 448 of SEQ ID NO:84, positions 17 to 446 of SEQ ID NO:85, positions 18 to 447 of SEQ ID NO:86, positions 18 to 443 of SEQ ID NO:87, positions 23 to 448 of SEQ ID NO:88, positions 18 to 451 of SEQ ID NO:89, positions 21 to 447 of SEQ ID NO:90, positions 18 to 444 of SEQ ID NO:91, positions 19 to 442 of SEQ ID NO:92, positions 20 to 436 of SEQ ID NO:93, positions 18 to 450 of SEQ ID NO:94, positions 22 to 453 of SEQ ID NO:95, positions 16 to 472 of SEQ ID NO:96, positions 21 to 445 of SEQ ID NO:97, positions 19 to 447 of SEQ ID NO:98, positions 19 to 450 of SEQ ID NO:99, positions 19 to 451 of SEQ ID NO:100, positions 18 to 448 of SEQ ID NO:101, positions 19 to 442 of SEQ ID NO:102, positions 20 to 457 of SEQ ID NO:103, positions 19 to 454 of SEQ ID NO:104, positions 18 to 440 of SEQ ID NO:105, positions 18 to 439 of SEQ ID NO:106, positions 27 to 460 of SEQ ID NO:107, positions 23 to 446 of SEQ ID NO:108, positions 17 to 446 of SEQ ID NO:109, positions 21 to 447 of SEQ ID NO:110, positions 19 to 447 of SEQ ID NO:111, positions 18 to 449 of SEQ ID NO:112, positions 22 to 457 of SEQ ID NO:113, positions 18 to 445 of SEQ ID NO:114, positions 18 to 448 of SEQ ID NO:115, positions 18 to 448 of SEQ ID NO:116, positions 23 to 435 of SEQ ID NO:117, positions 21 to 442 of SEQ ID NO:118, positions 23 to 435 of SEQ ID NO:119, positions 20 to 445 of SEQ ID NO:120, positions 21 to 443 of SEQ ID NO:121, positions 20 to 445 of SEQ ID NO:122, positions 23 to 443 of SEQ ID NO:123, positions 20 to 445 of SEQ ID NO:124, positions 21 to 435 of SEQ ID NO:125, positions 20 to 437 of SEQ ID NO:126, positions 21 to 442 of SEQ ID NO:127, positions 23 to 434 of SEQ ID NO:128, positions 20 to 444 of SEQ ID NO:129, positions 21 to 435 of SEQ ID NO:130, positions 20 to 445 of SEQ ID NO:131, positions 21 to 446 of SEQ ID NO:132, positions 21 to 435 of SEQ ID NO:133, positions 22 to 448 of SEQ ID NO:134, positions 23 to 433 of SEQ ID NO:135, positions 23 to 434 of SEQ ID NO:136, positions 23 to 435 of SEQ ID NO:137, positions 23 to 435 of SEQ ID NO:138, positions 20 to 445 of SEQ ID NO:139, positions 20 to 437 of SEQ ID NO:140, positions 21 to 435 of SEQ ID NO:141, positions 20 to 437 of SEQ ID NO:142, positions 21 to 435 of SEQ ID NO:143, positions 26 to 435 of SEQ ID NO:144, positions 23 to 435 of SEQ ID NO:145, positions 24 to 443 of SEQ ID NO:146, positions 20 to 445 of SEQ ID NO:147, positions 21 to 441 of SEQ ID NO:148, and positions 20 to 437 of SEQ ID NO:149 (preferably the CD corresponding to positions 26-455 of SEQ ID NO: 1 or 18-444 of SEQ ID NO:2); and/or comprise an amino acid sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a mature polypeptide of a reference CBH I exemplified in Table 1 (i.e., a mature protein comprising an amino acid sequence corresponding to positions 26 to 529 of SEQ ID NO:1, positions 18 to 514 of SEQ ID NO:2, positions 26 to 529 of SEQ ID NO:3, positions 1 to 427 of SEQ ID NO:4, positions 24 to 526 of SEQ ID NO:5, positions 18 to 512 of SEQ ID NO:6, positions 27 to 532 of SEQ ID NO:7, positions 27 to 539 of SEQ ID NO:8, positions 20 to 449 of SEQ ID NO:9, positions 1 to 424 of SEQ ID NO:10, positions 18 to 447 of SEQ ID NO:11, positions 18 to 434 of SEQ ID NO:12, positions 18 to 521 of SEQ ID NO:13, positions 19 to 454 of SEQ ID NO:14, positions 19 to 596 of SEQ ID NO:15, positions 2 to 426 of SEQ ID NO:16, positions 23 to 446 of SEQ ID NO:17, positions 19 to 525 of SEQ ID NO:18, positions 23 to 446 of SEQ ID NO:19, positions 19 to 530 of SEQ ID NO:20, positions 2 to 416 of SEQ ID NO:21, positions 19 to 454 of SEQ ID NO:22, positions 19 to 506 of SEQ ID NO:23, positions 19 to 447 of SEQ ID NO:24, positions 20 to 443 of SEQ ID NO:25, positions 18 to 447 of SEQ ID NO:26, positions 19 to 516 of SEQ ID NO:27, positions 18 to 451 of SEQ ID NO:28, positions 23 to 446 of SEQ ID NO:29, positions 18 to 514 of SEQ ID NO:30, positions 18 to 451 of SEQ ID NO:31, positions 18 to 447 of SEQ ID NO:32, positions 19 to 449 of SEQ ID NO:33, positions 18 to 447 of SEQ ID NO:34, positions 26 to 529 of SEQ ID NO:35, positions 19 to 528 of SEQ ID NO:36, positions 19 to 453 of SEQ ID NO:37, positions 18 to 512 of SEQ ID NO:38, positions 19 to 586 of SEQ ID NO:39, positions 19 to 510 of SEQ ID NO:40, positions 18 to 513 of SEQ ID NO:41, positions 24 to 541 of SEQ ID NO:42, positions 18 to 516 of SEQ ID NO:43, positions 19 to 453 of SEQ ID NO:44, positions 26 to 537 of SEQ ID NO:45, positions 19 to 523 of SEQ ID NO:46, positions 18 to 443 of SEQ ID NO:47, positions 18 to 511 of SEQ ID NO:48, positions 19 to 523 of SEQ ID NO:49, positions 18 to 513 of SEQ ID NO:50, positions 2 to 419 of SEQ ID NO:51, positions 27 to 535 of SEQ ID NO:52, positions 21 to 445 of SEQ ID NO:53, positions 19 to 449 of SEQ ID NO:54, positions 19 to 528 of SEQ ID NO:55, positions 18 to 443 of SEQ ID NO:56, positions 20 to 443 of SEQ ID NO:57, positions 18 to 514 of SEQ ID NO:58, positions 18 to 447 of SEQ ID NO:59, positions 26 to 529 of SEQ ID NO:60, positions 19 to 525 of SEQ ID NO:61, positions 19 to 532 of SEQ ID NO:62, positions 26 to 460 of SEQ ID NO:63, positions 18 to 510 of SEQ ID NO:64, positions 19 to 512 of SEQ ID NO:65, positions 19 to 521 of SEQ ID NO:66, positions 1 to 505 of SEQ ID NO:67, positions 19 to 526 of SEQ ID NO:68, positions 19 to 511 of SEQ ID NO:69, positions 23 to 447 of SEQ ID NO:70, positions 17 to 448 of SEQ ID NO:71, positions 19 to 449 of SEQ ID NO:72, positions 18 to 514 of SEQ ID NO:73, positions 23 to 540 of SEQ ID NO:74, positions 20 to 452 of SEQ ID NO:75, positions 18 to 504 of SEQ ID NO:76, positions 18 to 446 of SEQ ID NO:77, positions 22 to 536 of SEQ ID NO:78, positions 18 to 508 of SEQ ID NO:79, positions 1 to 431 of SEQ ID NO:80, positions 19 to 453 of SEQ ID NO:81, positions 21 to 440 of SEQ ID NO:82, positions 19 to 516 of SEQ ID NO:83, positions 18 to 448 of SEQ ID NO:84, positions 17 to 446 of SEQ ID NO:85, positions 18 to 523 of SEQ ID NO:86, positions 18 to 443 of SEQ ID NO:87, positions 23 to 448 of SEQ ID NO:88, positions 18 to 451 of SEQ ID NO:89, positions 21 to 447 of SEQ ID NO:90, positions 18 to 444 of SEQ ID NO:91, positions 19 to 510 of SEQ ID NO:92, positions 20 to 504 of SEQ ID NO:93, positions 18 to 450 of SEQ ID NO:94, positions 22 to 453 of SEQ ID NO:95, positions 16 to 536 of SEQ ID NO:96, positions 21 to 445 of SEQ ID NO:97, positions 19 to 517 of SEQ ID NO:98, positions 19 to 516 of SEQ ID NO:99, positions 19 to 523 of SEQ ID NO:100, positions 18 to 507 of SEQ ID NO:101, positions 19 to 516 of SEQ ID NO:102, positions 20 to 457 of SEQ ID NO:103, positions 19 to 454 of SEQ ID NO:104, positions 18 to 505 of SEQ ID NO:105, positions 18 to 516 of SEQ ID NO:106, positions 27 to 530 of SEQ ID NO:107, positions 23 to 446 of SEQ ID NO:108, positions 17 to 446 of SEQ ID NO:109, positions 21 to 447 of SEQ ID NO:110, positions 19 to 523 of SEQ ID NO:111, positions 18 to 513 of SEQ ID NO:112, positions 22 to 536 of SEQ ID NO:113, positions 18 to 445 of SEQ ID NO:114, positions 18 to 526 of SEQ ID NO:115, positions 18 to 538 of SEQ ID NO:116, positions 23 to 435 of SEQ ID NO:117, positions 21 to 442 of SEQ ID NO:118, positions 23 to 435 of SEQ ID NO:119, positions 20 to 445 of SEQ ID NO:120, positions 21 to 443 of SEQ ID NO:121, positions 20 to 445 of SEQ ID NO:122, positions 23 to 443 of SEQ ID NO:123, positions 20 to 445 of SEQ ID NO:124, positions 21 to 435 of SEQ ID NO:125, positions 20 to 437 of SEQ ID NO:126, positions 21 to 442 of SEQ ID NO:127, positions 23 to 434 of SEQ ID NO:128, positions 20 to 444 of SEQ ID NO:129, positions 21 to 435 of SEQ ID NO:130, positions 20 to 445 of SEQ ID NO:131, positions 21 to 446 of SEQ ID NO:132, positions 21 to 435 of SEQ ID NO:133, positions 22 to 448 of SEQ ID NO:134, positions 23 to 433 of SEQ ID NO:135, positions 23 to 434 of SEQ ID NO:136, positions 23 to 435 of SEQ ID NO:137, positions 23 to 435 of SEQ ID NO:138, positions 20 to 445, of SEQ ID NO:139, positions 20 to 437 of SEQ ID NO:140, positions 21 to 435 of SEQ ID NO:141, positions 20 to 437 of SEQ ID NO:142, positions 21 to 435 of SEQ ID NO:143, positions 26 to 435 of SEQ ID NO:144, positions 23 to 435 of SEQ ID NO:145, positions 24 to 443 of SEQ ID NO:146, positions 20 to 445 of SEQ ID NO:147, positions 21 to 441 of SEQ ID NO:148, and positions 20 to 437 of SEQ ID NO:149, preferably the mature polypeptide corresponding to positions 26-529 of SEQ ID NO:1 or 18-514 of SEQ ID NO:2).

An example of an algorithm that is suitable for determining sequence similarity is the BLAST algorithm, which is described in Altschul et al., 1990, J. Mol. Biol. 215:403-410. Software for performing BLAST analyses is publicly available through the National Center for Biotechnology Information. This algorithm involves first identifying high scoring sequence pairs (HSPs) by identifying short words of length W in the query sequence that either match or satisfy some positive-valued threshold score T when aligned with a word of the same length in a database sequence. These initial neighborhood word hits act as starting points to find longer HSPs containing them. The word hits are expanded in both directions along each of the two sequences being compared for as far as the cumulative alignment score can be increased. Extension of the word hits is stopped when: the cumulative alignment score falls off by the quantity X from a maximum achieved value; the cumulative score goes to zero or below; or the end of either sequence is reached. The BLAST algorithm parameters W, T, and X determine the sensitivity and speed of the alignment. The BLAST program uses as defaults a word length (W) of 11, the BLOSUM62 scoring matrix (see Henikoff & Henikoff, 1992, Proc. Nat'l. Acad. Sci. USA 89:10915-10919) alignments (B) of 50, expectation (E) of 10, M'S, N'-4, and a comparison of both strands.

Most CBH I polypeptides are secreted and are therefore expressed with a signal sequence that is cleaved upon secretion of the polypeptide from the cell. Accordingly, in certain aspects, the variant CBH I polypeptides of the disclosure further include a signal sequence. Exemplary signal sequences comprise amino acid sequences corresponding to positions 1 to 25 of SEQ ID NO:1, positions 1 to 17 of SEQ ID NO:2, positions 1 to 25 of SEQ ID NO:3, positions 1 to 23 of SEQ ID NO:5, positions 1 to 17 of SEQ ID NO:6, positions 1 to 26 of SEQ ID NO:7, positions 1 to 27 of SEQ ID NO:8, positions 1 to 19 of SEQ ID NO:9, positions 1 to 17 of SEQ ID NO:11, positions 1 to 17 of SEQ ID NO:12, positions 1 to 17 of SEQ ID NO:13, positions 1 to 18 of SEQ ID NO:14, positions 1 to 18 of SEQ ID NO:15, positions 1 to 22 of SEQ ID NO:17, positions 1 to 18 of SEQ ID NO:18, positions 1 to 22 of SEQ ID NO:19, positions 1 to 18 of SEQ ID NO:20, positions 1 to 18 of SEQ ID NO:22, positions 1 to 18 of SEQ ID NO:23, positions 1 to 18 of SEQ ID NO:24, positions 1 to 19 of SEQ ID NO:25, positions 1 to 17 of SEQ ID NO:26, positions 1 to 18 of SEQ ID NO:27, positions 1 to 17 of SEQ ID NO:28, positions 1 to 22 of SEQ ID NO:29, positions 1 to 18 of SEQ ID NO:30, positions 1 to 17 of SEQ ID NO:31, positions 1 to 17 of SEQ ID NO:32, positions 1 to 18 of SEQ ID NO:33, positions 1 to 17 of SEQ ID NO:34, positions 1 to 25 of SEQ ID NO:35, positions 1 to 18 of SEQ ID NO:36, positions 1 to 18 of SEQ ID NO:37, positions 1 to 17 of SEQ ID NO:38, positions 1 to 18 of SEQ ID NO:39, positions 1 to 18 of SEQ ID NO:40, positions 1 to 17 of SEQ ID NO:41, positions 1 to 23 of SEQ ID NO:42, positions 1 to 17 of SEQ ID NO:43, positions 1 to 18 of SEQ ID NO:44, positions 1 to 25 of SEQ ID NO:45, positions 1 to 18 of SEQ ID NO:46, positions 1 to 17 of SEQ ID NO:47, positions 1 to 17 of SEQ ID NO:48, positions 1 to 18 of SEQ ID NO:49, positions 1 to 17 of SEQ ID NO:50, positions 1 to 26 of SEQ ID NO:52, positions 1 to 20 of SEQ ID NO:53, positions 1 to 18 of SEQ ID NO:54, positions 1 to 18 of SEQ ID NO:55, positions 1 to 17 of SEQ ID NO:56, positions 1 to 19 of SEQ ID NO:57, positions 1 to 17 of SEQ ID NO:58, positions 1 to 17 of SEQ ID NO:59, positions 1 to 25 of SEQ ID NO:60, positions 1 to 18 of SEQ ID NO:61, positions 1 to 18 of SEQ ID NO:62, positions 1 to 25 of SEQ ID NO:63, positions 1 to 17 of SEQ ID NO:64, positions 1 to 18 of SEQ ID NO:65, positions 1 to 18 of SEQ ID NO:66, positions 1 to 18 of SEQ ID NO:68, positions 1 to 18 of SEQ ID NO:69, positions 1 to 23 of SEQ ID NO:70, positions 1 to 17 of SEQ ID NO:71, positions 1 to 18 of SEQ ID NO:72, positions 1 to 17 of SEQ ID NO:73, positions 1 to 22 of SEQ ID NO:74, positions 1 to 19 of SEQ ID NO:75, positions 1 to 17 of SEQ ID NO:76, positions 1 to 17 of SEQ ID NO:77, positions 1 to 21 of SEQ ID NO:78, positions 1 to 18 of SEQ ID NO:79, positions 1 to 18 of SEQ ID NO:81, positions 1 to 20 of SEQ ID NO:82, positions 1 to 18 of SEQ ID NO:83, positions 1 to 17 of SEQ ID NO:84, positions 1 to 16 of SEQ ID NO:85, positions 1 to 17 of SEQ ID NO:86, positions 1 to 17 of SEQ ID NO:87, positions 1 to 22 of SEQ ID NO:88, positions 1 to 17 of SEQ ID NO:89, positions 1 to 20 of SEQ ID NO:90, positions 1 to 17 of SEQ ID NO:91, positions 1 to 18 of SEQ ID NO:92, positions 1 to 19 of SEQ ID NO:93, positions 1 to 17 of SEQ ID NO:94, positions 1 to 21 of SEQ ID NO:95, positions 1 to 15 of SEQ ID NO:96, positions 1 to 20 of SEQ ID NO:97, positions 1 to 18 of SEQ ID NO:98, positions 1 to 18 of SEQ ID NO:99, positions 1 to 18 of SEQ ID NO:100, positions 1 to 17 of SEQ ID NO:101, positions 1 to 18 of SEQ ID NO:102, positions 1 to 19 of SEQ ID NO:103, positions 1 to 18 of SEQ ID NO:104, positions 1 to 17 of SEQ ID NO:105, positions 1 to 17 of SEQ ID NO:106, positions 1 to 26 of SEQ ID NO:107, positions 1 to 22 of SEQ ID NO:108, positions 1 to 16 of SEQ ID NO:109, positions 1 to 20 of SEQ ID NO:110, positions 1 to 18 of SEQ ID NO:111, positions 1 to 17 of SEQ ID NO:112, positions 1 to 21 of SEQ ID NO:113, positions 1 to 17 of SEQ ID NO:114, positions 1 to 17 of SEQ ID NO:115, positions 1 to 18 of SEQ ID NO:116, positions 1 to 22 of SEQ ID NO:117, positions 1 to 20 of SEQ ID NO:118, positions 1 to 22 of SEQ ID NO:119, positions 1 to 19 of SEQ ID NO:120, positions 1 to 20 of SEQ ID NO:121, positions 1 to 19 of SEQ ID NO:122, positions 1 to 22 of SEQ ID NO:123, positions 1 to 19 of SEQ ID NO:124, positions 1 to 20 of SEQ ID NO:125, positions 1 to 19 of SEQ ID NO:126, positions 1 to 21 of SEQ ID NO:127, positions 1 to 22 of SEQ ID NO:128, positions 1 to 19 of SEQ ID NO:129, positions 1 to 20 of SEQ ID NO:130, positions 1 to 19 of SEQ ID NO:131, positions 1 to 20 of SEQ ID NO:132, positions 1 to 20 of SEQ ID NO:133, positions 1 to 21 of SEQ ID NO:134, positions 1 to 22 of SEQ ID NO:135, positions 1 to 22 of SEQ ID NO:136, positions 1 to 22 of SEQ ID NO:137, positions 1 to 22 of SEQ ID NO:138, positions 1 to 19 of SEQ ID NO:139, positions 1 to 19 of SEQ ID NO:140, positions 1 to 20 of SEQ ID NO:141, positions 1 to 19 of SEQ ID NO:142, positions 1 to 20 of SEQ ID NO:143, positions 1 to 25 of SEQ ID NO:144, positions 1 to 22 of SEQ ID NO:145, positions 1 to 23 of SEQ ID NO:146, positions 1 to 19 of SEQ ID NO:147, positions 1 to 20 of SEQ ID NO:148, and positions 1 to 19 of SEQ ID NO:149.

Recombinant Expression of Variant CBH I Polypeptides
Cell Culture Systems

The disclosure also provides recombinant cells engineered to express variant CBH I polypeptides. Suitably, the variant CBH I polypeptide is encoded by a nucleic acid operably linked to a promoter.

Where recombinant expression in a filamentous fungal host is desired, the promoter can be a filamentous fungal promoter. The nucleic acids can be, for example, under the control of heterologous promoters. The variant CBH I polypeptides can also be expressed under the control of constitutive or inducible promoters. Examples of promoters that can be used include, but are not limited to, a cellulase promoter, a xylanase promoter, the 1818 promoter (previously identified as a highly expressed protein by EST mapping *Trichoderma*). For example, the promoter can suitably be a cellobiohydrolase, endoglucanase, or β-glucosidase promoter. A particularly suitable promoter can be, for example, a *T. reesei* cellobiohydrolase, endoglucanase, or β-glucosidase promoter. Non-limiting examples of promoters include a cbh1, cbh2, egl1, egl2, egl3, egl4, egl5, pki1, gpd1, xyn1, or xyn2 promoter.

Suitable host cells include cells of any microorganism (e.g., cells of a bacterium, a protist, an alga, a fungus (e.g., a yeast or filamentous fungus), or other microbe), and are preferably cells of a bacterium, a yeast, or a filamentous fungus.

Suitable host cells of the bacterial genera include, but are not limited to, cells of *Escherichia, Bacillus, Lactobacillus, Pseudomonas*, and *Streptomyces*. Suitable cells of bacterial species include, but are not limited to, cells of *Escherichia coli, Bacillus subtilis, Bacillus licheniformis, Lactobacillus brevis, Pseudomonas aeruginosa*, and *Streptomyces lividans*.

Suitable host cells of the genera of yeast include, but are not limited to, cells of *Saccharomyces, Schizosaccharomyces, Candida, Hansenula, Pichia, Kluyveromyces*, and *Phaffia*. Suitable cells of yeast species include, but are not limited to, cells of *Saccharomyces cerevisiae, Schizosaccharomyces pombe, Candida albicans, Hansenula polymorpha, Pichia pastoris, P. canadensis, Kluyveromyces marxianus*, and *Phaffia rhodozyma*.

Suitable host cells of filamentous fungi include all filamentous forms of the subdivision Eumycotina. Suitable cells of filamentous fungal genera include, but are not limited to, cells of *Acremonium, Aspergillus, Aureobasidium, Bjerkandera, Ceriporiopsis, Chrysoporium, Coprinus, Coriolus, Corynascus, Chaetomium, Cryptococcus, Filobasidium, Fusarium, Gibberella, Humicola, Hypocrea, Magnaporthe, Mucor, Myceliophthora, Mucor, Neocallimastix, Neurospora, Paecilomyces, Penicillium, Phanerochaete, Phlebia, Piromyces, Pleurotus, Scytaldium, Schizophyllum, Sporotrichum, Talaromyces, Thermoascus, Thielavia, Tolypocladium, Trametes*, and *Trichoderma*. More preferably, the recombinant cell is a *Trichoderma* sp. (e.g., *Trichoderma reesei*), *Penicillium* sp., *Humicola* sp. (e.g., *Humicola insolens*); *Aspergillus* sp. (e.g., *Aspergillus niger*), *Chrysosporium* sp., *Fusarium* sp., or *Hypocrea* sp. Suitable cells can also include cells of various anamorph and teleomorph forms of these filamentous fungal genera.

Suitable cells of filamentous fungal species include, but are not limited to, cells of *Aspergillus awamori, Aspergillus fumigatus, Aspergillus foetidus, Aspergillus japonicus, Aspergillus nidulans, Aspergillus niger, Aspergillus oryzae, Chrysosporium lucknowense, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Bjerkandera adusta, Ceriporiopsis aneirina, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Coprinus cinereus, Coriolus hirsutus, Humicola insolens, Humicola lanuginosa, Mucor miehei, Myceliophthora thermophila, Neurospora crassa, Neurospora intermedia, Penicillium purpurogenum, Penicillium canescens, Penicillium solitum, Penicillium funiculosum, Phanerochaete chrysosporium, Phlebia radiate, Pleurotus eryngii, Talaromyces flavus, Thielavia terrestris, Trametes villosa, Trametes versicolor, Trichoderma harzianum, Trichoderma koningii, Trichoderma longibrachiatum, Trichoderma reesei*, and *Trichoderma viride*.

The engineered host cells can be cultured in conventional nutrient media modified as appropriate for activating promoters, selecting transformants, or amplifying the nucleic acid sequence encoding the variant CBH I polypeptide. Culture conditions, such as temperature, pH and the like, are those previously used with the host cell selected for expression, and will be apparent to those skilled in the art. As noted, many references are available for the culture and production of many cells, including cells of bacterial and fungal origin. Cell culture media in general are set forth in Atlas and Parks (eds.), 1993, The Handbook of Microbiological Media, CRC Press, Boca Raton, Fla., which is incorporated herein by reference. For recombinant expression in filamentous fungal cells, the cells are cultured in a standard medium containing physiological salts and nutrients, such as described in Pourquie et al., 1988, Biochemistry and Genetics of Cellulose Degradation, eds. Aubert, et al., Academic Press, pp. 71-86; and Ilmen et al., 1997, Appl. Environ. Microbiol. 63:1298-1306. Culture conditions are also standard, e.g., cultures are incubated at 28° C. in shaker cultures or fermenters until desired levels of variant CBH I expression are achieved. Preferred culture conditions for a given filamentous fungus may be found in the scientific literature and/or from the source of the fungi such as the American Type Culture Collection (ATCC). After fungal growth has been established, the cells are exposed to conditions effective to cause or permit the expression of a variant CBH I.

In cases where a variant CBH I coding sequence is under the control of an inducible promoter, the inducing agent, e.g., a sugar, metal salt or antibiotics, is added to the medium at a concentration effective to induce variant CBH I expression.

In one embodiment, the recombinant cell is an *Aspergillus niger*, which is a useful strain for obtaining overexpressed polypeptide. For example *A. niger* var. *awamori* dgr246 is known to product elevated amounts of secreted cellulases (Goedegebuur et al., 2002, *Curr. Genet.* 41:89-98). Other strains of *Aspergillus niger* var *awamori* such as GCDAP3, GCDAP4 and GAP3-4 are known (Ward et al., 1993, Appl. Microbiol. Biotechnol. 39:738-743).

In another embodiment, the recombinant cell is a *Trichoderma reesei*, which is a useful strain for obtaining overexpressed polypeptide. For example, RL-P37, described by Sheir-Neiss et al., 1984, Appl. Microbiol. Biotechnol. 20:46-53, is known to secrete elevated amounts of cellulase enzymes. Functional equivalents of RL-P37 include *Trichoderma reesei* strain RUT-C30 (ATCC No. 56765) and strain QM9414 (ATCC No. 26921). It is contemplated that these strains would also be useful in overexpressing variant CBH I polypeptides.

Cells expressing the variant CBH I polypeptides of the disclosure can be grown under batch, fed-batch or continuous fermentations conditions. Classical batch fermentation is a closed system, wherein the compositions of the medium is set at the beginning of the fermentation and is not subject to artificial alternations during the fermentation. A variation of the batch system is a fed-batch fermentation in which the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. Continuous fermentation is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

Recombinant Expression in Plants

The disclosure provides transgenic plants and seeds that recombinantly express a variant CBH I polypeptide. The disclosure also provides plant products, e.g., oils, seeds, leaves, extracts and the like, comprising a variant CBH I polypeptide.

The transgenic plant can be dicotyledonous (a dicot) or monocotyledonous (a monocot). The disclosure also provides methods of making and using these transgenic plants and seeds. The transgenic plant or plant cell expressing a variant CBH I can be constructed in accordance with any method known in the art. See, for example, U.S. Pat. No. 6,309,872. *T. reesei* CBH I has been successfully expressed in transgenic tobacco (*Nicotiana tabaccum*) and potato (*Solanum tuberosum*). See Hooker et al., 2000, in Glycosyl Hydrolases for Biomass Conversion, ACS Symposium Series, Vol. 769, Chapter 4, pp. 55-90.

In a particular aspect, the present disclosure provides for the expression of CBH I variants in transgenic plants or plant organs and methods for the production thereof. DNA expression constructs are provided for the transformation of plants with a nucleic acid encoding the variant CBH I polypeptide, preferably under the control of regulatory sequences which are capable of directing expression of the variant CBH I polypeptide. These regulatory sequences include sequences capable of directing transcription in plants, either constitutively, or in stage and/or tissue specific manners.

The expression of variant CBH I polypeptides in plants can be achieved by a variety of means. Specifically, for example, technologies are available for transforming a large number of plant species, including dicotyledonous species (e.g., tobacco, potato, tomato, *Petunia, Brassica*) and monocot species. Additionally, for example, strategies for the expression of foreign genes in plants are available. Additionally still, regulatory sequences from plant genes have been identified that are serviceable for the construction of chimeric genes that can be functionally expressed in plants and in plant cells (e.g., Klee, 1987, Arm. Rev. of Plant Phys. 38:467-486; Clark et al., 1990, Virology 179(2):640-7; Smith et al., 1990, Mol. Gen. Genet. 224(3):477-81.

The introduction of nucleic acids into plants can be achieved using several technologies including transformation with *Agrobacterium tumefaciens* or *Agrobacterium rhizogenes*. Non-limiting examples of plant tissues that can be transformed include protoplasts, microspores or pollen, and explants such as leaves, stems, roots, hypocotyls, and cotyls. Furthermore, DNA encoding a variant CBH I can be introduced directly into protoplasts and plant cells or tissues by microinjection, electroporation, particle bombardment, and direct DNA uptake.

Variant CBH I polypeptides can be produced in plants by a variety of expression systems. For instance, the use of a constitutive promoter such as the 35S promoter of Cauliflower Mosaic Virus (Guilley et al., 1982, Cell 30:763-73) is serviceable for the accumulation of the expressed protein in virtually all organs of the transgenic plant. Alternatively, promoters that are tissue-specific and/or stage-specific can be used (Higgins, 1984, Annu. Rev. Plant Physiol. 35:191-221; Shotwell and Larkins, 1989, In:The Biochemistry of Plants Vol. 15 (Academic Press, San Diego: Stumpf and Conn, eds.), p. 297), permit expression of variant CBH I polypeptides in a target tissue and/or during a desired stage of development.

Compositions Of Variant Cbh I Polypeptides

In general, a variant CBH I polypeptide produced in cell culture is secreted into the medium and may be purified or isolated, e.g., by removing unwanted components from the cell culture medium. However, in some cases, a variant CBH I polypeptide may be produced in a cellular form necessitating recovery from a cell lysate. In such cases the variant CBH I polypeptide is purified from the cells in which it was produced using techniques routinely employed by those of skill in the art. Examples include, but are not limited to, affinity chromatography (Van Tilbeurgh et al., 1984, FEBS Lett. 169 (2):215-218), ion-exchange chromatographic methods (Goyal et al., 1991, Bioresource Technology, 36:37-50; Fliess et al., 1983, Eur. J. Appl. Microbiol. Biotechnol. 17:314-318; Bhikhabhai et al., 1984, J. Appl. Biochem. 6:336-345; Ellouz et al., 1987, Journal of Chromatography, 396:307-317), including ion-exchange using materials with high resolution power (Medve et al., 1998, J. Chromatography A, 808:153-165), hydrophobic interaction chromatography (Tomaz and Queiroz, 1999, J. Chromatography A, 865:123-128), and two-phase partitioning (Brumbauer et al., 1999, Bioseparation 7:287-295).

The variant CBH I polypeptides of the disclosure are suitably used in cellulase compositions. Cellulases are known in the art as enzymes that hydrolyze cellulose (beta-1,4-glucan or beta D-glucosidic linkages) resulting in the formation of glucose, cellobiose, cellooligosaccharides, and the like. Cellulase enzymes have been traditionally divided into three major classes: endoglucanases ("EG"), exoglucanases or cellobiohydrolases (EC 3.2.1.91) ("CBH") and beta-glucosidases (EC 3.2.1.21) ("BG") (Knowles et al., 1987, TIBTECH 5:255-261; Schulein, 1988, Methods in Enzymology 160(25):234-243).

Certain fungi produce complete cellulase systems which include exo-cellobiohydrolases or CBH-type cellulases, endoglucanases or EG-type cellulases and (3-glucosidases or BG-type cellulases (Schulein, 1988, Methods in Enzymology 160(25):234-243). Such cellulase compositions are referred to herein as "whole" cellulases. However, sometimes these systems lack CBH-type cellulases and bacterial cellulases also typically include little or no CBH-type cellulases. In addition, it has been shown that the EG components and CBH components synergistically interact to more efficiently degrade cellulose. See, e.g., Wood, 1985, Biochemical Society Transactions 13(2):407-410.

The cellulase compositions of the disclosure typically include, in addition to a variant CBH I polypeptide, one or more cellobiohydrolases, endoglucanases and/or β-glucosidases. In their crudest form, cellulase compositions contain the microorganism culture that produced the enzyme components. "Cellulase compositions" also refers to a crude fermentation product of the microorganisms. A crude fermentation is preferably a fermentation broth that has been separated from the microorganism cells and/or cellular debris (e.g., by centrifugation and/or filtration). In some cases, the enzymes in the broth can be optionally diluted, concentrated, partially purified or purified and/or dried. The variant CBH I polypeptide can be co-expressed with one or more of the other components of the cellulase composition or it can be expressed separately, optionally purified and combined with a composition comprising one or more of the other cellulase components.

When employed in cellulase compositions, the variant CBH I is generally present in an amount sufficient to allow release of soluble sugars from the biomass. The amount of variant CBH I enzymes added depends upon the type of biomass to be saccharified which can be readily determined by the skilled artisan. In certain embodiments, the weight percent of variant CBH I polypeptide is suitably at least 1, at least 5, at least 10, or at least 20 weight percent of the total polypeptides in a cellulase composition. Exemplary cellulase compositions include a variant CBH I of the disclosure in an amount ranging from about 1 to about 20 weight percent, from about 1 to about 25 weight percent, from about 5 to about 20 weight percent, from about 5 to about 25 weight percent, from about 5 to about 30 weight percent, from about 5 to about 35 weight percent, from about 5 to about 40 weight percent, from about 5 to about 45 weight percent, from about 5 to about 50 weight percent, from about 10 to about 20 weight percent, from about 10 to about 25 weight percent, from about 10 to about 30 weight percent, from about 10 to about 35 weight percent, from about 10 to about 40 weight percent, from about 10 to about 45 weight percent, from about 10 to about 50 weight percent, from about 15 to about 20 weight percent, from about 15 to about 25 weight percent, from about 15 to about 30 weight percent, from about 15 to about 35 weight percent, from about 15 to about 30 weight percent, from about 15 to about 45 weight percent, or from about 15 to about 50 weight percent of the total polypeptides in the composition.

Utility of Variant CBH I Polypeptides

It can be appreciated that the variant CBH I polypeptides of the disclosure and compositions comprising the variant CBH I polypeptides find utility in a wide variety applications, for example detergent compositions that exhibit enhanced cleaning ability, function as a softening agent and/or improve the feel of cotton fabrics (e.g., "stone washing" or "biopolishing"), or in cellulase compositions for degrading wood pulp into sugars (e.g., for bio-ethanol production). Other applications include the treatment of mechanical pulp (Pere et al., 1996, Tappi Pulping Conference, pp. 693-696 (Nashville, Tenn., Oct. 27-31, 1996)), for use as a feed additive (see, e.g., WO 91/04673) and in grain wet milling.

Saccharification Reactions

Ethanol can be produced via saccharification and fermentation processes from cellulosic biomass such as trees, herbaceous plants, municipal solid waste and agricultural and forestry residues. However, the ratio of individual cellulase enzymes within a naturally occurring cellulase mixture produced by a microbe may not be the most efficient for rapid conversion of cellulose in biomass to glucose. It is known that endoglucanases act to produce new cellulose chain ends which themselves are substrates for the action of cellobiohydrolases and thereby improve the efficiency of hydrolysis of the entire cellulase system. The use of optimized cellobiohydrolase activity may greatly enhance the production of ethanol.

Cellulase compositions comprising one or more of the variant CBH I polypeptides of the disclosure can be used in saccharification reaction to produce simple sugars for fermentation. Accordingly, the present disclosure provides methods for saccharification comprising contacting biomass with a cellulase composition comprising a variant CBH I polypeptide of the disclosure and, optionally, subjecting the resulting sugars to fermentation by a microorganism.

The term "biomass," as used herein, refers to any composition comprising cellulose (optionally also hemicellulose and/or lignin). As used herein, biomass includes, without limitation, seeds, grains, tubers, plant waste or byproducts of food processing or industrial processing (e.g., stalks), corn (including, e.g., cobs, stover, and the like), grasses (including, e.g., Indian grass, such as Sorghastrum nutans; or, switchgrass, e.g., *Panicum* species, such as *Panicum virgatum*), wood (including, e.g., wood chips, processing waste), paper, pulp, and recycled paper (including, e.g., newspaper, printer paper, and the like). Other biomass materials include, without limitation, potatoes, soybean (e.g., rapeseed), barley, rye, oats, wheat, beets, and sugar cane bagasse.

The saccharified biomass (e.g., lignocellulosic material processed by enzymes of the disclosure) can be made into a number of bio-based products, via processes such as, e.g., microbial fermentation and/or chemical synthesis. As used herein, "microbial fermentation" refers to a process of growing and harvesting fermenting microorganisms under suitable conditions. The fermenting microorganism can be any microorganism suitable for use in a desired fermentation process for the production of bio-based products. Suitable fermenting microorganisms include, without limitation, filamentous fungi, yeast, and bacteria. The saccharified biomass can, for example, be made it into a fuel (e.g., a biofuel such as a bioethanol, biobutanol, biomethanol, a biopropanol, a biodiesel, a jet fuel, or the like) via fermentation and/or chemical synthesis. The saccharified biomass can, for example, also be made into a commodity chemical (e.g., ascorbic acid, isoprene, 1,3-propanediol), lipids, amino acids, polypeptides, and enzymes, via fermentation and/or chemical synthesis.

Thus, in certain aspects, the variant CBH I polypeptides of the disclosure find utility in the generation of ethanol from biomass in either separate or simultaneous saccharification and fermentation processes. Separate saccharification and fermentation is a process whereby cellulose present in biomass is saccharified into simple sugars (e.g., glucose) and the simple sugars subsequently fermented by microorganisms (e.g., yeast) into ethanol. Simultaneous saccharification and fermentation is a process whereby cellulose present in biomass is saccharified into simple sugars (e.g., glucose) and, at the same time and in the same reactor, microorganisms (e.g., yeast) ferment the simple sugars into ethanol.

Prior to saccharification, biomass is preferably subject to one or more pretreatment step(s) in order to render cellulose material more accessible or susceptible to enzymes and thus more amenable to hydrolysis by the variant CBH I polypeptides of the disclosure.

In an exemplary embodiment, the pretreatment entails subjecting biomass material to a catalyst comprising a dilute solution of a strong acid and a metal salt in a reactor. The biomass material can, e.g., be a raw material or a dried material. This pretreatment can lower the activation energy, or the temperature, of cellulose hydrolysis, ultimately allowing higher yields of fermentable sugars. See, e.g., U.S. Pat. Nos. 6,660,506; 6,423,145.

Another exemplary pretreatment method entails hydrolyzing biomass by subjecting the biomass material to a first hydrolysis step in an aqueous medium at a temperature and a pressure chosen to effectuate primarily depolymerization of hemicellulose without achieving significant depolymerization of cellulose into glucose. This step yields a slurry in which the liquid aqueous phase contains dissolved monosaccharides resulting from depolymerization of hemicellulose, and a solid phase containing cellulose and lignin. The slurry is then subject to a second hydrolysis step under conditions that allow a major portion of the cellulose to be depolymerized, yielding a liquid aqueous phase containing dissolved/ soluble depolymerization products of cellulose. See, e.g., U.S. Pat. No. 5,536,325.

A further exemplary method involves processing a biomass material by one or more stages of dilute acid hydrolysis using about 0.4% to about 2% of a strong acid; followed by treating the unreacted solid lignocellulosic component of the acid hydrolyzed material with alkaline delignification. See, e.g., U.S. Pat. No. 6,409,841. Another exemplary pretreatment method comprises prehydrolyzing biomass (e.g., lignocellulosic materials) in a prehydrolysis reactor; adding an acidic liquid to the solid lignocellulosic material to make a mixture; heating the mixture to reaction temperature; maintaining reaction temperature for a period of time sufficient to fractionate the lignocellulosic material into a solubilized portion containing at least about 20% of the lignin from the lignocellulosic material, and a solid fraction containing cellulose; separating the solubilized portion from the solid fraction, and removing the solubilized portion while at or near reaction temperature; and recovering the solubilized portion. The cellulose in the solid fraction is rendered more amenable to enzymatic digestion. See, e.g., U.S. Pat. No. 5,705,369. Further pretreatment methods can involve the use of hydrogen peroxide $H_2O_2$. See Gould, 1984, Biotech. and Bioengr. 26:46-52.

Pretreatment can also comprise contacting a biomass material with stoichiometric amounts of sodium hydroxide and ammonium hydroxide at a very low concentration. See Teixeira et al., 1999, Appl. Biochem. and Biotech. 77-79:19-34. Pretreatment can also comprise contacting a lignocellulose with a chemical (e.g., a base, such as sodium carbonate or potassium hydroxide) at a pH of about 9 to about 14 at moderate temperature, pressure, and pH. See PCT Publication WO2004/081185.

Ammonia pretreatment can also be used. Such a pretreatment method comprises subjecting a biomass material to low ammonia concentration under conditions of high solids. See, e.g., U.S. Patent Publication No. 20070031918 and PCT publication WO 06/110901.

Detergent Compositions Comprising Variant CBH I Proteins

The present disclosure also provides detergent compositions comprising a variant CBH I polypeptide of the disclosure. The detergent compositions may employ besides the variant CBH I polypeptide one or more of a surfactant, including anionic, non-ionic and ampholytic surfactants; a hydrolase; a bleaching agents; a bluing agent; a caking inhibitors; a solubilizer; and a cationic surfactant. All of these components are known in the detergent art.

The variant CBH I polypeptide is preferably provided as part of cellulase composition. The cellulase composition can be employed from about 0.00005 weight percent to about 5 weight percent or from about 0.0002 weight percent to about 2 weight percent of the total detergent composition. The cellulase composition can be in the form of a liquid diluent, granule, emulsion, gel, paste, and the like. Such forms are known to the skilled artisan. When a solid detergent composition is employed, the cellulase composition is preferably formulated as granules.

EXAMPLES

Materials and Methods
Preparation Of CBH I Polypeptides For Biochemical Characterization Protein expression was carried out in an *Aspergillus niger* host strain that had been transformed using PEG-mediated transformation with expression constructs for CBHI that included the hygromycin resistance gene as a selectable marker, in which the full length CBH I sequences (signal sequence, catalytic domain, linker and cellulose binding domain) were under the control of the glyceraldeyhde-3-phosphate dehydrogenase (gpd) promoter. Transformants were selected on the regeneration medium based on resistance to hygromycin. The selected transformants were cultured in *Aspergillus* salts medium, pH 6.2 supplemented with the antibiotics penicillin, streptomycin, and hygromycin, and 80 g/L glycerol, 20 g/L soytone, 10 mM uridine, 20 g/L MES) in baffled shake flasks at 30° C., 170 rpm. After five days of incubation, the total secreted protein supernatant was recovered, and then subjected to hollow fiber filtration to concentrate and exchange the sample into acetate buffer (50 mM NaAc, pH 5). CBH I protein represented over 90% of the total protein in these samples. Protein purity was analyzed by SDS-PAGE. Protein concentration was determined by gel densitometry and/or HPLC analysis. All CBH I protein concentrations were normalized before assay and concentrated to 1-2.5 mg/ml.

CBH I Activity Assays

4-Methylumbelliferyl Lactoside (4-MUL) Assay: This assay measures the activity of CBH I on the fluorogenic substrate 4-MUL (also known as MUL). Assays were run in a costar 96-well black bottom plate, where reactions were initiated by the addition of 4-MUL to enzyme in buffer (2 mM 4-MUL in 200 mM MES pH 6). Enzymatic rates were monitored by fluorescent readouts over five minutes on a SPECTRAMAX™ plate reader (ex/em 365/450 nm). Data in the linear range was used to calculate initial rates (Vo).

Phosphoric Acid Swollen Cellulose (PASC) Assay: This assay measures the activity of CBH I using PASC as the substrate. During the assay, the concentration of PASC is monitored by a fluorescent signal derived from calcofluor binding to PASC (ex/em 365/440 nm). The assay is initiated by mixing enzyme (15 µl) and reaction buffer (85 µl of 0.2% PASC, 200 mM MES, pH 6), and then incubating at 35° C. while shaking at 225 RPM. After 2 hours, one reaction volume of calcofluor stop solution (100 µg/ml in 500 mM glycine pH 10) is added and fluorescence read-outs obtained (ex/em 365/440 nm).

Bagasse Assay: This assay measures the activity of CBH I on bagasse, a lignocellulosic substrate. Reactions were run in 10 ml vials with 5% dilute acid pretreated bagasse (250 mg solids per 5 ml reaction). Each reaction contained 4 mg CBH I enzyme/g solids, 200 mM MES pH 6, kanamycin, and chloramphenicol. Reactions were incubated at 35° C. in hybridization incubators (Robbins Scientific), rotating at 20 RPM. Time points were taken by transferring a sample of homogenous slurry (150 µl) into a 96-well deep well plate and quenching the reaction with stop buffer (450 µl of 500 mM sodium carbonate, pH 10). Time point measurements were taken every 24 hours for 72 hours.

Cellobiose Tolerance Assays (or Cellobiose Inhibition Assays): Tolerance to cellobiose (or inhibition caused by cellobiose) was tested in two ways in the CBH I assays. A direct-dose tolerance method can be applied to all of the CBH I assays (i.e., 4-MUL, PASC, and/or bagasse assays), and entails the exogenous addition of a known amount of cellobiose into assay mixtures. A different indirect method entails the addition of an excess amount of β-glucosidase (BG) to PASC and bagasse assays (typically, 1 mg β-glucosidase/g solids loaded). BG will enzymatically hydrolyze the cellobiose generated during these assays; therefore, CBH I activity in the presence of BG can be taken as a measure of activity in the absence of cellobiose. Furthermore, when activity in the presence and absence of BG are similar, this indicates tolerance to cellobiose. Notably, in cases where BG activity is undesired, but may be present in crude CBH I enzyme preparations, the BG inhibitor gluconolactone can be added into CBH I assays to prevent cellobiose breakdown.

Library Screening Assays

The wild type CBH I polypeptide BD29555 was mutagenized to identify variants with improved product tolerance. A small (60-member) library of BD29555 variants was designed to identify variant CBH I polypeptides with reduced product inhibition. This product-release-site library was designed based on residues directly interacting with the cellobiose product in an attempt to identify variants with weakened interactions with cellobiose from which the product would be released more readily than the wild type enzyme. The 60-member evolution library contained wild-type residues and mutations at positions R273, W405, and R422 of BD29555 (SEQ ID NO:1), and included the following substitutions: R273 (WT), R273Q, R273K, R273A, W405 (WT), W405Q, W405H, R422 (WT), R422Q, R422K, R422L, and R422E (4 variants at position 273×3 variants at position 405×5 variants at position 422 equals 60 variants in total). All members of the library were screened using the 4-MUL assay in the presence and absence of 250 g/L cellobiose and using gluconolactone to inhibit any BG activity. The R273A, R273Q, and R273K/R422K variants showed enhanced product tolerance. The R273K/R422K variant showed greatest activity among the variants and cellobiose tolerance at 250 mg/L. Due to low expression, the R273K variant was not tested for product inhibition.

Characterization of Product Tolerant Variants of BD29555

The R273K/R422K substitutions were characterized in both a wild type BD29555 background and also in combination with the substitutions Y274Q, D281K, Y410H, P411G, which were identified in a screen of an expanded product release site evolution library.

The wild type, the R273K/R422K variant and the R273K/ Y274Q/D281K/Y410H/P411G/R422K variants were tested for activity on 4-MUL in the presence and absence of 250 mg/L cellobiose, and the R273K/R422K variant was also tested in the bagasse assay in the presence and absence of BG. The results are summarized in Table 5.

The results from these activity assays were converted into the percentage of activity remaining with and without cellobiose present, where values close to 100% indicated cellobiose tolerance. The percent of activity remaining in the MUL assay in the presence cellobiose versus in the absence of cellobiose shows that the R273K/R422K variant was the most tolerant, followed by the R273K/Y274Q/D281K/Y410H/ P411G/R422K variant, and then wild-type, at 95%, 78%, and 25% activity, respectively.

Cellobiose dose response curves of the wild-type and R273K/R422K variant of BD29555 were obtained during the 4-MUL assay. Enzyme rates (Vo) were measured in the presence of different concentrations of cellobiose (200 mM MES pH 6, 25° C.). Rates were measured in quadruplicate. The results are shown in FIG. 1A-1B. FIG. 1A shows that wild type BD2955 is inhibited by cellobiose, with a half maximal inhibitory concentration ($IC_{50}$ value) of 60 mg/L. FIG. 1B shows that the R273K/R422K variant is tolerant to cellobiose up to 250 mg/L.

The bagasse assay results shown in Table 5, which lists the percentage of activity remaining in the absence vs. presence of BG, also demonstrate that the percentage activity of the wild type BD29555 is lower than the percentage activity of the R273K/R422K variant, indicating that the R273K/R422K variant is less sensitive to the presence of cellobiose than the wild type. FIG. 2A-2B shows bar graph data for the bagasse assay of BD29555 vs. the R273K/R422K variant. In FIG. 2A, bars represent relative activity, which has been normalized to wild type activity in the absence of cellobiose (WT+ BG=uninhibited activity=1). In FIG. 2B, bars indicate tolerance to cellobiose, as represented by the ratio of activity in the presence of cellobiose (−BG) to that of activity in the absence of cellobiose (+BG); ratios close to 1 indicate greater tolerance to cellobiose. These data again demonstrate that the R273K/R422K variant of BD29555 is more tolerant to cellobiose than the wild type BD29555.

The wild type and R273K/R422K variant were also characterized in the PASC assay. Results are shown in FIG. 3. The activities of both wild type BD29555 (SEQ ID NO:1) and wild type *T. reesei* CBH I (SEQ ID NO:2) were inhibited by cellobiose concentrations starting around 1 g/L (with $IC_{50}$ values of 2.2 and 3 g/L, respectively), whereas the R273K/ R422K variant showed little inhibition in the presence of 10 g/L cellobiose.

Characterization of Product Tolerant Variants of *T. Reesei* CBH I

Cellobiose product tolerant substitutions were introduced into *T. reesei* CBH I (SEQ ID NO:2). A panel of variants with single and double alanine and lysine substitutions at R268 and R411 were expressed and analyzed. The variants were tested for activity on 4-MUL in the presence and absence of 250 mg/L cellobiose and also in the bagasse assay in the absence and presence of BG. The results from these assays were converted into the percentage activity remaining in the presence and absence of cellobiose and BG, respectively. Values are summarized in Table 6.

The 4-MUL assay results shown in Table 6 demonstrate that the activity of the wild type *T. reesei* CBH I was reduced to 23% in the presence of cellobiose, whereas the double mutants at R268 and R411 retained more than 90% of their activity under the same conditions.

The bagasse assay results shown in Table 6 demonstrate that the activity of the wild type *T. reesei* CBH I is more significantly impacted by the presence of BG than is the activity of the single or double substitution variants, indicating that the variants are less sensitive to the accumulation of cellobiose than the wild type. FIGS. 4 and 5 show bar graph data for the bagasse assay of wild type *T. reesei* CBH I vs. the variants. In FIG. 4, bars represent relative activity, normalized to wild type activity in the absence of cellobiose (WT+ BG=1). In FIG. 5, bars represent tolerance to cellobiose, as represented by the ratio of activity in the presence of accumulating cellobiose (−BG) to that of activity in the absence of cellobiose (+BG); ratios close to 1 indicate greater tolerance to cellobiose.

Specific Embodiments and Incorporation by Reference

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated, that various changes can be made without departing from the spirit and scope of the invention(s).

TABLE 1

| Sequence Identifier (SEQ ID NO:) | Database Accession Number | Species of Origin | Amino acid sequence |
|---|---|---|---|
| SEQ ID NO: 1 | BD29555* | Unknown | MSALNSFNMY KSALLIGSLL ATAGAQQIGT YTAETHPSLS WSTCKSGGSC TTNSGAITLD ANWRWVHGVN TSTNCYTGNT WNTAICDTDA SCAQDCALDG ADYSGTYGIT TSGNSLRLNF VTGSNVGSRT YLMADNTHYQ IPDLLNQEFT FTVDVSHLPC GLNGALYFVT MDADGGVSKY PNNKAGAQYG VGYCDSQCPR DLKFIAGQAN VEGWTPSSNN ANTGLGNHGA CCAELDIWEA NSISEALTPH PCDTPGLSVC TTDACGGTYS SDRYAGTCDP DGCDFNPYRL GVTDFYGSGK TVDTKPITV VTQPVTDDGT STGTLSEIRR YVQNGVVIP QPSSKISGVS GNVINSDFCD AEISTFGETA SFSKHGGLAK MGAGMEAGMV LVMSLWDDYS VNMLWLDSTY PTNATGTPGA ARGSCPPTSG DPKTVESQSG SSYVTFSDIR VGPFNSTFSG GSSTGGSSTT TASGTTTKA SSTSTSSTST GTGVAAHWGQ CGGQGWTGPT TCASGTTCTV VNPYYSQCL |
| SEQ ID NO: 2 | 340514556 | Trichoderma reesei | MYRKLAVISA FLATARAQSA CTLQESETHPP LTWQKCSSGG TCTQQTGSVV IDANWRWTHA TNSSTNCYDG NTWSSTLCPD NETCAKNCCL DGAAYASTYG VTTSGNSLSI GFVTQSAQKN VGARLYLMAS DTTYQEFTLL GNEFSFDVDV SQLPCGLNGA LYFVSMDADG GVSKYPTNTA GAKYGTGYCD SQCPRDLKFI NGQANVEGWE PSSNNANTGI GGHGSCCSEM DIWEANSISE ALTPHPCTTV GQEICEGDGC GGTYSDNRYG GTCDPDGCDW NPYRLGNTSF YGPGSSFTLD TTKKLTVVTQ FETSGAINRY YVQNGVTFQQ PNAELGSYSG NELNDDYCTA EERAEFGGSSF SDKGLTQFK KATSGGMVLV MSLWDDYYAN MLWLDSTYPT NETSSTPGAV RGSCSTSSGV PAQVESQSPN AKVTFSNIKF GPIGSTGNPS GGNPPGGNPP GTTTTRRPAT TTGSSPGPTQ SHYGQCGGIG YSGPTVCASG TTCQVLNPYY SQCL |
| SEQ ID NO: 3 | 51243029 | Penicillium occitanis | MSALNSFNMY KSALLIGSLL ATAGAQQIGT YTAETHPSLS WSTCKSGGSC TTNSGAITLD ANWRWVHGVN TSTNCYTGNT WNSAICDTDA SCAQDCALDG GLNGALYFVT MDADGGVSKY PNNKAGAQYG VGYCDSQCPR DLKFIAGQAN IPDLLNQEFT FTVDVSHLPC CCAELDIWEA NSISEALTPH PCDTPGLSVC TTDACGGTYS SDRYAGTCDP VEGWTPSANN ANTGIGNHGA GVTDFYGSGK TVDTKPFTV VTQFVTNDGT STGSLSEIRR YVQNGVVIP QPSSKISGIS DGCDFNPYRL AEISTFGGTA SSYVTFSDIR MAAGMEAGMV VNMLWLDSTY PTNATGTPGA GNVINSDYCA DPKTVESQSG SSTGGSTTT TASRTTTTSA SSTSTSSTST ARGTCATTSG CGGQGWTGPT TCVSGTTCTV VNPYYSQCL GTGVAGHWGQ |
| SEQ ID NO: 4 | 7cel (PDB) & | Trichoderma reesei | ESACTLQSET HPPLTWQKCS SGGTCTQQTG SVVIDANWRW THATNSSTNC YDGNTWSSTL CPDNETCAKN CCLDGAAYAS TYGVTTSGNS LSIDFVTQSA QKNVGARLYL MASDTTYQEF TLLGNEFSFD VDVSQLPCGL NGALYFVSMD ADGGVSKYPT NTAGAKYGTG YCDSQCPRDL KFINGQANVE GWEPSSNNAN TGIGGHGSCC SEMDIWQANS ISEALIPHPC TTVGQEICEG DGCGGTYSDN RYGGTCDPDG CDWNPYRLGN TSFYGPGSSF TLDTTKKLTV VTQFETSGAI NRYYVQNGVT FQQPNAELGS YSGNELNDDY CTAEEAEFGG SSFSDKGGLT QFKKATSGGM VLVMSLWDDY YANMLWLDST YPTNETSSTP GAVRGSCSTS SGVPAQVESQ SPNAKVTFSN IKFGPIGSTG NPSG |
| SEQ ID NO: 5 | 67516425 | Aspergillus nidulans FGSC A4 | MASSFQLYKA LLFFSSLLSA VQAQKVGTQQ AEVHPGLTWQ TCTSSGSCTT VNGEVTIDAN WRWLHTVNGY TNCYTGNEWD TSICTSNEVC AEBQCAVDGAN YASTYGITTS GSSLRLNFVT QSQQKNIGSR VYLMDDEDTY TMFYLLNKEF TFDVDVSELP CGLNGAVYFV SMDADGGKSR YATNEAGAKY GTGYCDSQCP RDLKFINGVA NVEGWESSDT NPNGGVGNHG SCCAEMDIWE ANSISTAFTP HPCDTPGQTL CTGDSCCGTY SNDRYGGTCD PDGCDFNSYR QGNKTFYGPG LTVDTNSPVT VVTQFLTDDN TDTGTLSEIK RFYVQNGVVI PNSESTYPAN PGNSITTBEFC ESQKELFGDV DVFSAHGGMA GMGAALEQGM IKFGPIGSTF RFYVQNGVVI YPTDADPTQP GIARGTCPTD SGVPSEVEAQ YPNAVVYSN WYSQCL TVTTSTATST TSSAATSTATG QAQHWEQCGG NGWTGPTVCA SPWACTVVNS |
| SEQ ID NO: 6 | 46107376 | Gibberella zeae PH-1 | MYRAIATASA LIAAVRAQQV CSLTQESKPS LNWSKCTSSG CSNVKGSVTI DANWRWTHQV SGSTNCYTGN KWDTSVCTSG KVCAEKCCLD GADYASTYGI TSSGDQLSLS FVTKGPYSTN IGSRTYLMED ENTYQMFQLL GNEFTFDVDV SNIGCGLNGA LYFVSMDADG GKAKYPGNKA GAKYGTGYCD AQCPRDVKFI NGQANSDGWQ PSDSDVNGGI GNLGTCCPEM DIWEANSIST AYTPHPCTKL TQHSCTGDSC GGTYSNDRYG GTCDADGCDF |

TABLE 1-continued

| Sequence Identifier (SEQ ID NO:) | Database Accession Number | Species of Origin | Amino acid sequence |
|---|---|---|---|
| | | | NSYRQGNKTF YGPGSGFNVD TTKKVTVTQ FHKGSNGRLS EITRLYQNG KVIANSESKI AGVPGNSLTA DPCTKQKKVF NDPDDFTKKG AWSGMSDALE APMVLVMSLW HDHHSNMLWL DSTYPTDSTK LGSQRGSCST SSGVPADLEK NVPNSKVAFS NIKFGPIGST YKSDGTTPTN PTNPSEPSNT ANPNPGTVDQ WGQCGGSNYS GPTACKSGFT CKKINDFYSQ CQ |
| SEQ ID NO: 7 | 70992391 | Aspergillus fumigatus Af293 | MLASTFSYRM YKTALILAAL LGSGQAQQVG TSQAEVHPSM TWQSCTAGGS CTTNNGKVVI DANWRWVHKV GDYTNCYTGN TWDTTICPDD ATCASNCALE GANYESTYGV TASGNSLRLN FVTTSQQKNI GSRLYMMKDD STYEMFKLLN QEFTFDVDVS NLPCGLNGAL YFVAMDADGG MSKYPTNKAG AKYGTGYCDS QCPRDLKFIN GQANVEGWQP SSNDANAGTG NHGSCCAEMD IWEANSISTA FTPHPCDTPG QVMCTGDACG GTYSSDRYGG TCDPDGCDFN SFRQGNKTFY GPGMTVDTKS KFTVVTQFIT DDGTSSGTLK EIKRFVYQNG KVIPNSESTW TGVSGNSITT EYCTAQKSLF QDQNVFEKHG GLEGMGAALA QGMVLVMSLW DDHSANMLWL DSNYPTTASS TTPGVARGTC DISSGVPIGK EANHPDAYVV YSNIKVGPIG STFNSGGSNP GGGTTTTTTT QPTTTTTTAG NPGGTGVAQH YGQCGGIGWT GPTTCASPYT CQKLNDYYSQ CL |
| SEQ ID NO: 8 | 121699984 | Aspergillus clavatus NRRL 1 | MLPSTISYRI YKNALFFAAL FGAVQAQKVG TSKAEVHPSM AWQTCAADGT CTTKNGKVVI DANWRWVHDV KGYTNCYTGN TWNAELCPDN ESCAENCALE GADYAATYGA TTSGNALSLK FVTQSQOKNI GSRLYMMKDD NTYETFKLLN QEFTFDVDVS NLPCGLNGAL YFVSMDADGG LSRYTGNEAG AKYGTGYCDS QCPRDLKFIN GLANVEGWTP SSSDANAGNG GHGSCCAEMD IWEANSISTA YTPHPCDTPG QAMCNGDSCG GTYSSDRYGG TCDPDGCDFN SYRQGNKSFY GPGMTVDTKK KMTVVTQFLT NDGTATGTLS EIKRFVYQDG KVIANSESTW PNLGGNSLTN DFCKAQKTVF GDMDTFSKHG GMEGMGAALA EGMVLVMSLW DDHNSNMLWL DSNSPTTGTS TTPGVARGSC DISSGDPKDL EANHPDASVV YSNIKVGPIG STFNSGGSNP GGSTTTTKPA TSTTTTKATT TATTNTTGPT GTGVAQPWAQ CGGIGYSGPT QCAAPYTCTK QNDYYSQCL |
| SEQ ID NO: 9 | 1906845 | Claviceps purpurea | MHPSLQTILL SALFTTAHAQ QACSSKPETH PPLSWSRCSR SGCRSVQGAV TVDANMLWTT VDGSQNCYTG NRMDTSICSS EKTCSESCCI DGADYAGTYG VTTTGDALSL KFVQQGPYSK NVGSRLYIMK DESRYEMFTL LGNEFTFDVD VSKLGCGLNG ALYFVSMDED GGMKRFPMNK AGAKFGTGYC DSQCPRDVKF INGMANSKDW IPSKSDANAG IGSLGACCRE MDIWEANNIA SAFTPHPCKN SAYHSCTDG CGGTYSKNRY SGDCDPDGCD FNSYRLGNTT FYGPGKFTI DTTRKISVVT QFLKGRDGSL REIKRFVYQN GKVIPNSVSR VRGVPGNSIT QGFCNAAQVN FGAHESFNAK SKPMVLVMSL WDDHNSNMLW LDSTYPTNSR QRGSKRGSCP ASSGRPTDVE SSAPDSTVF SNIKFGPIGS TFSRGK |
| SEQ ID NO: 10 | 1gp1 (PDB) & 119468034 | Phanerochaete chrysosporium | ESACTLQSET HPPLTWQKCS SGGTCTQQTG LSIDFVTQSA QKNVGARLYL KFINGQANVE GWEPSSNNAN TGIGHGSCC CCLDGAAYAS TYGVTTSGNS LSIDFVTQSA QKNVGARLYL YCDSQCPRDL RYGGTCDPDG CDWNPYRLGN TSFYGPGSSF NGALYFVSMD ADGGVSKYPT NTAGAKYGTG TTVGQEICEG DGCGGTYSDN FQQPNAELGS YSGNELNDDY CTAEEAEFGG SSFSDKGGLT SEMDIWQANS ISEALTPHPC VTQFETSGAI NRYYVQNGVT FQQPNAELGS YPTNETSSTP GAVRGSCSTS SGVPAQVESQ SPNAKVTFSN TLDTTKKLTV VTQFETSGAI NRYYVQNGVT YANMLWLDST YPTNETSSTP GAVRGSCSTS SGVPAQVESQ SPNAKVTFSN QFKKATSGDM VLVMSLWDDY YANMLWLDST IKFGPIGSTG NPSG |
| SEQ ID NO: 11 | 119468034 | Neosartorya fischeri NRRL 181 | MHQRALLFSA LAVAANAQQV GTQKPETHPP LTWQKCTAAG SCSQQSGSVV IDANWRWLHS TKDTTNCYTG NTWNTELCPD NESCAQNCAV DGADYAGTYG VTTSGSELKL SFVTGANVGS RLYLMQDDET YQHFNLLNNE FTFDVDVSNL PCGLNGALYF VAMDADGGMS KYPSNKAGAK YGTGYCDSQC PRDLKFINGM ANVEGWKPSS NDKNAGVGGH GSCCPEMDIW EANSISTAVT PHPCDDVSQT MCSGDACGGT YSATRYAGTC DPDGCDFNPF RMGNESFYGP GKIVDTKSEM TVVTQFITAD GTDTGALSEI KRLYVQNGKV IANSVSNVAD VSGNSISSDF CTAQKKAFGD EDIFAKHGGL SGMGKALSEM VLIMSIWDDH HSSMMWLDST YPTDADPSKP GVARGTCEHG AGDPEKVESQ HPDASVTFSN IKFGPIGSTY KA |
| SEQ ID NO: 12 | 7804883 | Leptosphaeria maculans | MYRSLIFATS LLSLAKGQLV GNLYCKGSCT AKNGKVIDA NWRWLHVKGG YTNCYTGNEW NATACPDNKS CATNCAIDGA DYRRLHYCE RQLLGTEVHH QGLYSTNIGS RTYLMQDDST YQLFKFTGSQ EFTFDVDLSN LPCGLNGALY FVSMDADGGL KKYPTNKAGA KYGTGYCDAQ KYGTGYCDAQ CPRDLKFING EGNVEGWQPS KNDQNAGVGG |

| Sequence Identifier (SEQ ID NO:) | Database Accession Number | Species of Origin | Amino acid sequence |
|---|---|---|---|
| SEQ ID NO: 13 | 85108032 | Neurospora crassa N150 (OR74A) | HGSCCAEMDI WEANSVSTAV TPHSCCSTIEQ SRCDGDGCGG TYSADRYAGV CDPDGCDFNS YRMGVKDFYG KGKTVDTSKK FTVVTQFIGS GDAMEIKRFY VQNGKTIPQP DSTIPGVTGN SITTFFCDAQ KKAFGDKYTF KDKGGMANMP STCNGMVLVM SLWDDHYSNM LWLDSTYPTD KNPDTDAGSG RGECAITSGV PADVESQHPD ASVIYSNIKF GPINTTFG |
| SEQ ID NO: 14 | 169859458 | Coprinopsis cinerea okayama | MLAKFAALAA LVASANAQAV CSLTAETHPS LNWSKCTSSG CTNVAGSITV DANWRWTHIT SGSTNCYSGN EWDTSLCSTN TDCATKCCVD GAEYSSTYGI QTSGNSLSLQ FVTKGSYSTN IGSRTYLMNG ADAYQGFELL GNEFTFDVDV SGTGCGLNGA LYFVSMDLDG GKAKYTNNKA GAKYTGYCD AQCPRDLKYI NGIANVEGWT PSTNDANAGI GDHGTCCSEM DIWEANKVST AFTPHPCTTI EQHMCEGDSC GGTYSDDRYG GTCDADGCDF NSYRMGNTTF YGEGKTVDTS SKFTVVTQFI KDSAGDLAEI KRFYVQNGKV IENSQSNVDG VSGNSITQSF CNAQKTAPGD IDDFNKKGGL KQMGKALAKP MVLVMSIWDD HAANMLWLDS TYPVEGGPGA YRGECPTTSG VPAEVEANAP NSKVIFSNIK FGPIGSTFSG GSSGTPPSNP SSSVKPVTST AKPSSTSTAS NPSGTGAAHW AQCGGIGPSG PTTCQSPYTC QKINDYYSQC V |
| SEQ ID NO: 15 | 154292161 | Botryotinia fuckeliana B05-10 | MFKKVALTAL CFLAVAQAQQ VGREVAENHP RLPWQRCRTRN GGCQTVSNGQ VVLDANWRWL HVTDGYTNCY TGNSWNSTVC SDPTTCQARC ALEGANYQQT YGITTNGDAL TIKFLTRSGQ TNVGARYLM ENENRYQMFN LLNKEFTPDV DVSKVPCGIN GALYFIQMDA DGGMSKQPNN RAGAKYTGY CDSQCPRDIK FIDGVANSAD WTPSETDPNA GRGRYGICCA EMDIWEANSI SNAYTPHPCR TQNDGGYQRC EGRDCNQPRY EGLCDPDGCD YNPFRMGNKD FYGPGKTVDT NRKMTVVTQF ITHDNTDTGT LVDIRRLYVQ DGRVIANPPT NFPGLMPAHD SITEQFCTDQ KNLFGDYSSF ARDGLAHMG RSLAKGHVLA LSIWNDHGAH MLWLDSNYPT DADPNKPGIA RGTCPTTGGT PRETEQNHPD AQVIFSNIKF GDIGSTFSGY |
| SEQ ID NO: 16 | 169615761 # | haeosphaeria nodorum SN15 | MYSAAVLATF SFLLGAGAQQ VGTSTAETHP ALTVQKCAAG GTCTDESDSI VLDANWRWLH STSGSTNCYT GNTWDTTLCP DAATCTTNCA LDGADYEGTY GITTSGDSLK LSFVTGSNVG SRTYLMDSET TYKEFALLGN EFTFTDVSK LPCGLNGALY FVPMDADGGM SKYPTNKAGA KYGTGYCDAQ CPQDMKFVNG TANVEGWVPD SNSANSGTGN IGSCCSEFPDV WEANSMSQAL TPHVCTVDSQ TACTGDDCAS NTGVCDGDGC DFNPYRMGNT TPYGSGMTID TSKPFSVVTQ FITDDGTETG TLTEIKRFYV QDDVVYEQPS SDISGVSGNS ITDDFCAAQK TAFGDTDYFT QNGGMAAMGK KMADGMVLVL SIMDDYNVAM LWLDSDYPTT KDASTPGVSR GSCATDSGVP ATVEAASGSA YVTFSSIKYG DSSSVSSAA SPAPIASSSS SASIAPVSSV VAAIVSSSAQ AISSAAPVUS SSAQAISSAA PVVSSVVSSA APVATSSTKS KCSKVSSTLK TSVAAPATSA TSAAVVATSS AASTGSVPL YGNCTGKTC SEGTCVVQND YYSQCVASS |
| SEQ ID NO: 17 | 4833502 | Humicola grisea | MTWQRCTGTG GSSCTNVNGE IVIDANWRWI HATGYTNCF DGNEWNKTAC PSNAACTKNC AIEGSDYRGT YGITTSGNSL TLKFIITKGQY STNVGSRTYL MKDTNNYEMF NLIGNEFTPD VDLSQLPCGL NGALYFVSMP EKGQGTPGAK YGTGKLSQCS VHISKTLTDA CARDLKFVGG EANADGWQAS TSDPNAGVGK YGACCAEMDV WEANSMSTAL TPHSCPEGY AVCEESNCGG TYSLDRYAGT CDANGCDFNP YRVGNKDFYG KGKTVDTSKK MTVVTQFLGT GSDLTELKRF YVQDGKVISN PEPTIPGMTG NSITQKWCDT QKEVFKEEVY PFNQWGGMAS MGKGMAQGMV LVMSLWDDHY SNMLWLDSTY PTDRDPESPG AARGECAITS GAPAEVEANN PDASVMFSNI KFGPIGSTFQ QPA |
| SEQ ID NO: 18 | 950686 | Humicola grisea | MQIKSYIQYL AAALPLLSSV AAQQAGTITA ENHPRMTWKR CSSGPNCQTV QGEVVIDANW RWLHHNGQNC YEGNKWTSQC SSATDCAQRC ALDGANYQST YGASTSGDSL TLKFVTKHEY GTNIGSRFYL MANQNKYQMF TLMNNEFAFD VDLSKVECGI NSALYFVAME EDGGMASYPS NRAGAKYTG YCDAQCARDL KFIGGKANIE GWRPSTNDPN AGVGPMGACC AEIDVWESNA VAYAFTPHAC GSKNRYHICE TNNCGGTYSD DRFAGYCDAN GCDYNPYRMG NKDFYGKGKT VDTNRKFTVV SRFERNRLSQ FFVQDGRKIE VPPPTWPGLP NSADITPELC DAQFRVFDDR NRFAETGGFD ALNEALTIPM VLVMSIWDDH HSNMLWLDSS YPPEKAGLPG GDRGPCPTTS GVPAEVEAQY PNAQVVWSNI RFGPIGSTVN V |
| SEQ ID NO: 19 | | | MRTAKFATLA ALVASAAAQQ ACSLITERHP SLSWKKCTAG GQCQTVQASI TLDSNWRWTH QVSGSTNCYT GNKMDTSICT DAKSCAQNCC VDGADYTSTY GITTNGDSLS LKFVTKGQYS TNVGSRTYLM DGEDKYQTFE |

TABLE 1-continued

| Sequence Identifier (SEQ ID NO:) | Database Accession Number | Species of Origin | Amino acid sequence |
|---|---|---|---|
| SEQ ID NO: 19 | 124491660 | Chaetomium thermophilum | LLGNEFTFDV DVSNIGCGLN GALYFVSMDA DGGLSRYPGN KAGAKYGTGY CDAQCPRDIK FINGEANIEG WTGSTNDPNA GAGRYGICCS EMDIWEANNM ATAFTPHPCT IIQSRCEGD SCGGTYSNER YAGVCDPDGC DFNSYRQGNK TFYGKGMTVD TTKKITVVTQ FLKDANGDLG EIKRFYVQDG KIIPNSESTI PGVEGNSITQ DWCDRQKVAF GDIDDFNRKG GMKQMGKALA GPMVLVMSIW DDHASNMLWL DSTFPVDAAG KPGAERGACP TTSGVPAEVE AEAPNSNVF SNIRFGPIGS TVAGLPGAGN GGNNGGNPPP PTTTTSSAPA TTTTASAGPK AGRMQQCCGI GFTGPTQCEE PYTCTKLNDW YSQCL |
| SEQ ID NO: 20 | 58045187 | Chaetomium thermophilum | MQIKQYLQYL AAALPLVNMA AAQRAGTQQT ETHPRLSWKR CSSGGNCQTV NAEIVIDANW RMLHDSNYQN CYDGNRWTSA CSSATDCAQK CYLEGANYGS TYGVSTGDA LTLKFVTKHE YGTNIGSRVY LMNGSDKYQM FTLMNNEFAF DVDLSKVECG LNSALYFVAM EEDGGMRSYS SNKAGAKYGT GYCDAQCARD LKFVGGKANI EGWRPSTNDA NAGVGPYGAC CAEIDVWESN AYAFAFTPHG CLNNNYHVCE TSNCGGTYSE DRFGGLCDAN GCDYNPYRMG NKDFYGKGKT VDTSRKFTVV TRFEENKLTQ FFIQDGRKID IPPPTWPGLP NSSAITPELC TNLSKVFDDR DRYEETGGFR TINEALRIPM VLVMSIWDGH YANMLWLDSV YPPEKAGQPG AERGPCAPTS GVPAEVEAQF PNAQVIWSNI RFGPIGSTYQ V |
| SEQ ID NO: 21 | 169601100 # | Phaeosphaeria nodorum SN15 | MMYKKFAALA ALVAGAAAQQ ACSLTTETHP RLTWKRCTSG GNCSTVNGAV TIDANWRTH TVSGSTNCYT GNEWDTSICS DGKSCAQTCC VDGADYSSTY GITTSGDSLN LKFVTKHQHG TNVGSRVYLM ENDTKYQMFE LLGNEFTFDV DVSNLGCGLN GALYFVSMDA DGGMSKYSGN KAGAKYGTGY CDAQCPRDLK FINGEANIEN WTPSTNDANA GFGRYGSCCS EMDIWDANNM ATAFTPHPCT IIQSRCEGN SCGGTYSSER YAGVCDPDGC DFNAYRQGDK TFYGKGMTVD TTKKMTVVTQ FHKNSAGVLS EIKRFYVQDG KIIANAESKI PGNPGNSITQ EWCDAQKVAF GDIDDFNRKG GMAQMSKALE GPMVLVMSVW DDHYANMLWL DSTYPIDKAG TPGAERGACP TTSGVPAEIE AQVPNSNVIF SNIRFGPIGS TVPGLDGSTP SNPTATVAPP TSTTTSVRSS TTQISTPTSQ PGGCTTQKMG QCCGIGYTGC TNCVAGTTCT ELNPWYSQCL |
| SEQ ID NO: 21 | 169601100 # | Phaeosphaeria nodorum SN15 | MYRNFLYAAS LLSVARSQLV GTQTTETHPG MTWQSCTAKG SCTTCSDNKA CASNCAVDGA DYKGTYGITA SGNSLQLKFI TKGSYSTNIG SRTYLMASDT AYQMFKFDGN KEFTFDVDLS GLPCGFNGAL YFVSMDEDGG LKKYSGNKAG AKYGTGYCDA QCPRDLKFIN GEGNVEGWKP SDNDANAGVG GKGHSCCAEMD IWEANSISTA VIPHACSTIE QTRCDGDCFN AYRMGVKNFY QKQVFGDRYT YKEKGGTANM AKALAQGMVL TGDAMEIKRF YVQGKTIEQ PASTIPGVEG NSITTKFCDQ SGRGSCDVKS GAPADVESKS PDATVIYSNI KFGPLNSTY VMSLWDDHYS NMLWLDSTYP TDKNPDTDLG |
| SEQ ID NO: 22 | 169870197 | Coprinopsis cinerea Okayama | MLGKIAIASL SFLAIAKGQQ VGREVAENHP RLPWQRCTRN GGCQTVSNGQ VVLDANWRWL HVTDGYTNCY TGNSWNSSVC SDGTTCAQRC ALEGANYQQT YGITTSGNSL TMKFLTRSQG TNVGGRVYLM ENENRYQMFN LLNKEFTFDV DVSKVPCGIN GALYFIQMDA DGGMSSQPNN SNAYTPHPCR TQNDGGYORC CDSQCPRDIK FIDGVANSVG WEPSETDSNA GRGRYGICCA EMDIWEANSI NRKMTVVTQF ITHDNTDTGT LVDIRRLVVQ EGRDCNQPRY EGLCDPDGCD YNPFRMGNKD FYGPGKTIDT KNLFGDYSSR ARDGLAHMKG RSLAKGHVLA LSTWNDHGAH MLWLDSNYPT NFPGLMPAHD SITEQFCTDQ PRETEQNHPD AQVIFSNIKF GDIGTFSGY DADPNKPGIA RGTCPTTGGT |
| SEQ ID NO: 23 | 3913806 | Agaricus bisporus | MPRSILLIAL SLTAVALGQQ VGTNMAENHP SLTWQRCTSS GCQNVNGKVT LDANWRWTHR INDFTNCYTG NEWDTSICPD GVTCAENCAL DGADYAGTYG VTSSGTALTL KFVTESQQKN IGSRLYLMAD DSNYEIFNLL NKEFTFDVDV SKLPCGLNGA LYFSEMAADG GMSSTNTAGA TPHPCREPGL QRCEGNTCSV CPRDIKFIDG EANSEGWEGS PNDVNAGTGN FGACCGEMDI WEANSISSAY TVDTNQPITV VTQFITDNGS DGNLIQEIRR IVYQNGVQIQ KYGTGYCDSQ NDRYATECDP DGCDFNSFRM GDKSFYGPGM NSNVNIPGID GNSISAEFC DQAKEAFGDE RSFQDRGGLS GMGSALDRGM VNLVSIWDDH AVNMLWLDSD YPLDASPSQP GISRGTCSRD SGKPEDVREAN AGGVQVVYSN IKFGDINSTF NNNGGGGGNP SPTTTRPNSP AQTMWGQCGG QGWTGPTACQ SPSTCHVIND FYSQCF |
| SEQ ID NO: 24 | 169611094 | Phaeosphaeria nodorum SN15 | MYRNLALASL SLFGAARAQQ AGTVTTETHP SLSWKTCTGT GGTSCTTKAG KITLDANWRW THVTGTNC YDGNSWNTIA CPDGATCTKN CAVDGADYSG TYGITTSSNS LSIKFVTKGS NSANIGSRTY LMESDTKYQM |

TABLE 1-continued

| Sequence Identifier (SEQ ID NO:) | Database Accession Number | Species of Origin | Amino acid sequence |
|---|---|---|---|
| SEQ ID NO: 25 | 3131 | Phanerochaete chrysosporium | FNLIGQEFTF DVDVSKLPCG LNGALYFVEM AADGGIGKGN NKAGAKYGTG YCDSQCPHDI KFINGKANVE GWNPSDADPN AGSGKIGACC PEMDIWEANS ISTAYTPHPC KGTGLQECTD DVSCGDGSNR YSGLCDKDGC DFNSYRMGVK DFYGPGATLD TTKKMTVVTQ FLGSGSTLSE IKRFYVQNGK VFKNSDSAIE GVTGNSITES FCAAQKTAFG DTNSFKTLGG LNEMGASLAR GHVLVMSLWD DHAVNMLWLD STYPTNSTKL GAQRGTCAID SGKPEDVEKN HPDATVFSD IKFGPIGSTF QQPS |
| SEQ ID NO: 26 | 70991503 | Aspergillus fumigatus Af293 | MVDIQIATFL LLGVVGVAAQ QVGTYIPENH PLLATQSCTA SGGCTTSSSK IVLDANRRWI HSTLGTTSCL TANGWDPTLC PDGITCANYC ALDGVSYAST YGITTSGSAL RLQFVTGTNI GSRVFLMADD THYRTFQLLN QELAFDVDVS KLPCGLNGAL YFVAMDADGG KSKYPGNRAG AKYGTGYCDS QCPRDVQFIN GQANVQGWNA TSATTGTGSY GSCCTELDIW EANSNAAALT PHTCTNNAQT RCSGSNCTSN TGFCDADGCD FNSFRLGNTT FLGAGMSVDT TKTFTVVTQF ITSDNTSTGN LTEIRRFYVQ NGNVIPNSVV NVTGIGAVNS ITDPFCSQQK KAFIETNYFA QHGGLAQLGQ ALRTGMTLAF SISDDPANHM LWLDSNFPPS ANPAVPGVAR GMCSITSGNP ADVGILNPSP YVSFLNIKFG SIGTTPRPA |
| SEQ ID NO: 27 | 294196 | Phanerochaete chrysosporium | MHQRALLFSA LAVAANAQQV GTQTPETHPP LTWQKCTAAG SCSQQSGSVV IDANWRWLHS TKDTTNCYTG NTWNTELCPD NESCAQNCAL DGADYASTYG VTTSGNSLKL SFVTGSNVGS RLYLMQDDET YQHFNLLNHE FTFDVDVSNL PCGLNGALYF VAMDADGGMS KYPSNKAGAK YGTGYCDSQC PRDLKFINGM ANVEGWEPSS SDKNAGVGGH GSCCPEMDIW EANSISTAVT PHPCDDVSQT MCSGDACGGT YSESRYAGTC DPDGCDFNPF RMGNESFYGP GKIVDTKSKM TVTQFITAD GTDSGALSEI KRLYVQNGKV IANSVSNVAG VSGNSITSDF CTAQKKAFGD EDIFAKHGGL SGMGKALSEM VLIMSIWDDH HSSMMWLDST YPTDADPSKP GVARGTCEHG AGDPENVESQ HPDASVTFSN IKFGPIGSTY EG |
| SEQ ID NO: 28 | 18997123 | Thermoascus aurantiacus | MFRTATLLAF TMAAMVFGQQ VGTNTAENHR TLTSQKCTKS GGCSNLNTKI VLDANWRWLH STSGYTNCYT GNQMDATLCP DGKTCAANCA LDGADYTGTY GITASGSSLK LQFVTGSNVG KYGTGYCDSQ CPRDIKFING HYOMFOLLNQ EFTFDVDMSN LPCGLNGALY LSAMDADGGM AKYPTNKAGA KYGTGYCDSQ CSGSDCTRDT GLCDADGCDF NSFRMGDQTF SANAGTGNYG TCCTEMDIWE ANNDAAAYTP HPCTTNAQTR CSGSDCTRDT GKVIQNSSVK IPGIDPVNSI TDNFCSQQKT LGKGLTVDTS KPFTVVTQFI TNDGTSAGTL TEIRRLYVQN WLDSNYPINK DPSTPGVARG TCATTSGVPA APGDTNYFAQ HGGLKQVGEA LRTGMVLALS LNTTYTGTVS SSSVSSHSS TSTSSHSSS STPPTQPFGV TVPQWGQCGG QIEAQSPNAY VVFSNIKFGD IGYTGSTTCA SPYTCHVLNP YYSQCY |
| SEQ ID NO: 28 | 18997123 | Thermoascus aurantiacus | MYQRALLFSF FLAAARAHEA GTVTAENHPS LTWQQCSSGG SCTTQNGKVV IDANWRWVHT TSGYTNCYTG NTWDTSICPD DVTCAQNCAL DGADYSGTYG VTTSGNALRL NFVTQSSGKN IGSRLYLLQD DTTYQIFKLL GQEFTFDVDV SNLPCGLNGA LYFVAMDADG NLSKYPGNKA GAKYGTGYCD SQCPRDLKFI NGQANVEGWQ PSANDPNAGV GNHGSSCAEM DWEANSIST AVTPHPCDTP GQTMCQGDDC GGTYSSTRYA GTCDDPGCDF NPYQPGNHSF YGPGKIVDTS SKFTVVTQFI TDDGTPSGTL TEIKRFYVQN GKVIPQSEST ISGVTGNSIT TEYCTAQKAA FGDNTGFFTH GGLQKVGQAL AQGMVLVMSL WDDHAANMLW LDSTYPTDAD PDTPGVARGT CPTTSGVPAD VESQNPNSYV IYSNIKVGPI NSTFTAN |
| SEQ ID NO: 29 | 4204214 | Humicola grisea var thermoidea | MQIKSYIQYL AAALPLLSSV AAQQAGTITA ENHPRMTWKR CSGPGNCQTV QGHEVIDANW RMLHNNGQNC YEGNKWTSQC SSATDCAQRC ALDGANYSST YGASTSGDSL TLKFVTKHEY GTNIGSRFYL MANQNKYQMF TLMNNEFAPD VDLSKVECGI NSALYFVAME EDGGMASYPS NRAGAKYGTG YCDAQCARDL KFIGGKANIE GWRPSTNDPN AGVGPMGACC AEIDVWESNA YAYAFTPHAC GSKNRYHLCE TNNCGGTYSD DRFAGYCDAN GCDYNVRYMG NKDFYGKGKT VDTNRKFTVV SRFERNRLSQ FFVQDGRKIE VPPPTWPGLP NSADITPELC DAQFRVFDDR NRFAETGGFD ALNEALTIPM VLVMSIWDDH HSNMLWLDSS YPPEKAGLPG GDRGPCPTTS GVPAEVEAQY PDAQVVWSNI RFGPIGSTVN V |
| SEQ ID NO: 30 | 34582632 | Trichoderma viride (also known as Hypochrea rufa) | MYRKLAVISA FLATARAQSA CTLQSETHPP LTWQKCSSGG TCTQQTGSVV IDANWRWTHA TNSSTNCYDG NTWSSTLCPD NETCAKNCCL DGAAYASTYG VTTSGNSLSI GFVTQSAQKN VGARLYLMAS DTTYQEFTLL GNEFSFDVDV SQLPCGLNGA LYFVSMDADG GVSKYPTNTA GAKYGTGYCD SQCPRDLKFI NGQANVEGWE |

TABLE 1-continued

| Sequence Identifier (SEQ ID NO:) | Database Accession Number | Species of Origin | Amino acid sequence |
|---|---|---|---|
| SEQ ID NO: 31 | 156712284 | Thermoascus aurantiacus | PSSNNANTGI GGHGSCCSEM DIWEANSISE ALTPHPCTTV GQEICEGDGC GGTYSDNRYG GTCDPDGCDW DPYRLGNTSF YGPGSSFTLD TTKKLTVVTQ FETSGAINRY YVQNGVTFQQ PNAELGSYSG NGLNDDYCTA EEAEFGGSSF SDKGGLTQFK KATSGGMVLV MSLWDDYYAN MLWLDSTYPT NETSSTPGAV RGSCSTSSGV PAQVESQSPN AKVTFSNIKF GPIGSTGDPS GGNPPGGNPP GTTTRRPAT TTGSSPGPTQ SHYGQCGIG YSGPTVCASG TTCQVLNPYY SQCL |
| SEQ ID NO: 32 |  | Thermoascus aurantiacus | MYQRALLFSF FLAAARAQQA GTVTAENHPS LTWQQCSSGG SCTTQNGKVV IDANWRWTH TSGYTNCYTG NTWDTSICPD DVTCAQNCAL DGADYSGTYG VTTSGNALRL NFVTQSSGKN IGSRLYLLQD DTTYQIFKLL GQEFTFDVDV SNLPCGLNGA LYFVAMDADG GLSKYPGNKA GAKYGTGYCD SQCPRDLKFI NGQANVEGWQ PSANDPNAGV GNHGSCCAEM DWEANSIST AVTPHPCDTP GQTMCQGDDC GGTYSSTRYA GTCDPDGCDF NPYRQGNHSF YGPGQIVDTS SKFTVVTQFI TDDGTPSGTL TEIKRFYVQN GKVIPQSEST ISGVTGNSIT TEYCTAQKEA FGDNTGFFTH GGLQKISQAL AQGMVLVMSL WDDHAAMMLW LDSTYPTDAD PDTPGVARGT CPTTSGVPAD VESQYPNSYV IYSNIKVGPI NSTFTAN |
| SEQ ID NO: 33 | 39977899 | Magnaporthe grisea (oryzae) 70-15 | MIRKITTLAA LVGVVRGQAA CSLITAETHPS LTWQKCSSGG SCTNVAGSVT IDANWRWTHT TSGYTNCYTG NKWDTSICT NADCASKCCV DGANYQGTYG ASTSGNALSL QVTTQSSGKN VGSRLYLLES ENKYQMFNLL GNEFTFDVDA SKLIGCGLNGA VYFVSMDADG GQSKYSGNKA GAKYGTGYCD SQCPRDLKYI NGAANVEGWQ PSSGDANSGV GNMGSCCAEM DIWEANSIST AYTPHPCSNN AQHSCKGDDC GGTYSSVRYA GDCDPDGCDF NSYRQGNRTF YGPGSNFNVD SSKKVTVVTQ FISSGGQLTD IKRFYVQNGK VIPNSQSTIT GVTGNSVTQD YCDKQKTAFG DQNVFNQRGG LRQMGDALAK GMVLVMSVWD DHSQMLWLD STYPTTSTAP GAARGSCSTS SGKPSDVQSQ TPGATVVYSN IKFGPIGSTF KSS |
| SEQ ID NO: 34 | 20986705 | Talaromyces emersonii | MLRRALLLSS SAILAVKAQQ AGTATAENHP PLTMQECTAP GSCTTQNGAV VLDANWRVH DVNGYTNCYT GNTWDPTYCP DDETCAQNCA LDGADYEGTY GVTSSGSSLK LNFVTGSNVG SRLYLLQDDS TYQIFKLLNR EFSFDVDVSN LPCGLNGALY FVAMDADGGV SKYPNNKAGA KYGTGYCDSQ CPRDLKFIDG EANVEGWQPS SNNANTGIGD HGSCCAEMDV WEANSISNAV TPHPCDTPGQ TMCSGDDCGG TYSNDRYAGT CPDPGCDFNP YRMGNTSPYG PDKIIDTTKP FTVVTQFLTD DGTDTGTLSE IKRFYIQNSN VIPQPNSDIS GVTGNSITTE FCTAQKQAFG DTDDFSQHGG LAKMGAAMQQ GMVLVMSLWD DYAAQMLWLD SDYPTDADPT TPGIARGTCP TDSGVPSDVE SQSPNSVVTY SNIKFGPINS TFTAS |
| SEQ ID NO: 35 | 22138843 | Aspergillus oryzae | MHQRALLFSA FWTAVAQQA GTLITAETHPS LTWQKCAAGG TCTEQKGSVV LDSNWRLHS VDGSTNCYTG NTWDATLCPD NESCASNCAL DGADYEGTYG VTTSGDALTL QFVTGANIGS RLYLMADDDE SYQTFNLLNN EFTFDVDASK LPCGLNGAVY FVSMADGGV AKYSTNKAGA KYGTGYCDSQ CPRDLKFING QVRKGWEPSD SDKNAGVGGH GSCCPQMDIW TVVTQFITAD PHPCDDTAQT MCEGDTCGGT YSSERYAGTC DPDGCDFNAY RMGNESFYGP SKLVDSSSPV TVVTQFITAD GTDSGALSEI KRFYVQGGKV IANAASNVDG VTGNSITADF CTAQKKAFGD DDIFAQHGGL QGMGNALSSM VLTLSIWDDH HSSMMWLDSS YPEDADATAP GVARGTCEPH AGDPEKVESQ SGSATVTYSN IKYGPIGSTF DAPA |
| SEQ ID NO: 35 | 55775695 | Penicillium chrysogenum | MASTLSFKIY KNALLLAAFL GAAQAQQVGT STAEVHPSLT WQKCTAGGSC TSQSGKVVID SNWRWVHNTG GYTNCYTGND WDRTLCPDDV TCATNCALDG ADYKGTYGVT ASGSSLRLNF VTQASQKNIG SRLYLMADDS KYEMFQLLNQ EFTFDVDVSN LPCGLNGALY FVAMDEDGGM ARYPTNKAGA KYGTGYCDAQ CPRDLKFING QANVEGWEPS SSDVNGGTGN YGSCCAEMDI WEANSISTAF TPHPCDDPAQ TRCTGDSCGG TYSSDRYGGT CDPDGCDFNP YRMGNQSFYG PSKIVDTESP FTVVTQFITN DGTSTGTLSE IKRFYVQNGK VIPQSVSTIS AVTGNSITDS FCSAQKTAFK DTDVFAKHGG MAGMGAGLAE GMVLVMSLWD DHAANMLWLD STYPTSASST TPGAARGSCD ISSGEPSDVE ANHSNAYVVY SNIKVGPLGS TFGSTDSSGG TTTTKVTTTT ATKTTTTGP STTGAAHYAQ CGGQNWTGPT TCASPYTCQR QGDYSQCL |
| SEQ ID NO: 36 | 171676762 | Podospora anserina | MVSAKFAALA ALVASASAQQ VCSLTPESHP PLTWQRCSAG GSCTNVAGSV TLDSNWRWTH TLQGSTNCYS GNEWDTSICT TGTKCAQNCC VEGAEXAATY GITTSGNQLN LKFVTEGKYS TNVGSRTYLM ENATKYQGFN LLGNEFTFDV DVSNIGCGLN GALYFVSMDL DGGLAKYSGN KAGAKYGTGY CDAQCPRDIK FINGEANIEG |

TABLE 1-continued

| Sequence Identifier (SEQ ID NO:) | Database Accession Number | Species of Origin | Amino acid sequence |
|---|---|---|---|
| SEQ ID NO: 37 | 146350520 | Pleurotus sp Florida | WNPSTNDVNA GAGRYGTCCS EMDIWEANNM ATAYTPHSCT ILDQSRCEGE SCGGTYSSDR YGGVCDPDGC DFNSYRMGNK EFYGKGKTVD TTKKMTVVTQ FLKNAAGELS EIKRFYVQNG VVIPNSVSSI PGVPNQNSIT QDWCDAQKIA FGDPDDNTAK GGLRQMGLAL DKPMVLVMSI WNDHAAHMLW LDSTYPVDAA GRPGAERGAC PTTSGVPSEV EAEAPNSVA FSNIKFGPIG STFNSGSTNP NPISSTATT PSTRVSSTS TAAQTPTSAP GGTVPRWGQC GGQGYTGPTQ CVAPYTCVVS NQWYSQCL |
| SEQ ID NO: 38 | 37732123 | Gibberella zeae | MPFYIALVSF SFLSVVLAQQ VGTLTAETHP QLTVQQCTRG GSCTTQQRSV VLDGNWRWLH STSGSNNCYT GNTWDTSLCP DAATCSRNCA LDGADYASTYG GITSSGNALT LKFVTHGPYS TNIGSRVYLL ADDSHYQMFN LKNKEFTFDV DVSQLPCGLN GALYFSQMDA DGGTGRFPNN KAGAKYGTGY CDSQCPHDIK FINGEANVQG WQPSNDSNA GKGQYSGCCA EMDIWEANSM ASAYTPHPCT VTTPTRCQGN DCGDGDNRYG GVCDKDGCDF NSFRMGDKNF LGPGKTVNTN SKFTVVTQFL TSDNTTSGTL SEIRRLYVQN GRVIQNSKVN IPGMASTLDS ITESFCSTQK TVFGDTNSFA SKGGLRAMGN AFDKGMVLVL SIWDDHEARM LWLDSNYPLD KSASAPGVAR GTCATTSGEP KDVESQSPNA QVIFSNIKYG DIGSTYSN |
| SEQ ID NO: 39 | 156055188 | Sclerotinia sclerotiorum 1980 | MYRAIATASA LIAAVRAQQV CSLTQESKPS LNWGSKCTSSG CSNVKGSVTI DANWRWTHQV SGSTNCYTGN KWDTSVCTSG KVCAERCCLD GADYASTYGI TSSGDQLSLS FVTKGPYSTN IGSRTYLMED ENTYQMFQLL GNEFTFDVDV SNIGCGLNGA LYFVSMDADG GKAKYPGNKA GAKYGTGYCD AQCPRDVKFI NGQANSDGWQ PSDSDVNGGI GNLGTCCPEM DIWEANSIST AYTPHPCTKL TQHSCTGDSC GGTYSNDRYG GTCDADGCDF NSYRQGNKTF YGPGSGFNVD TTKKVTVVTQ FHKGSNGRLS EITRLYVQNG KVIANSESKI AGVPGNSLTA DFCTKQKKVF NDPDDFTKKG AWSGMSDALE APMVLVMSLW HDHHSNMLWL DSTYPTDSTK LGSQRGSCST SSGVPADLEK NVPNSKVAFS NIKFGPIGST YKSDGTTPTN PTNPSEPSNT ANPNPGTVDQ WGQCGGSNYS GPTACKSGFT CKKINDFYSQ CQ |
| SEQ ID NO: 40 | 453224 | Phanerochaete chrysosporium | MYSAAVLATF SFLLGAGAQQ VGTLKTESHP PLTIQKCAAG GTCTDEADSV VLDANWRWLH STSGSTNCYT GNTWDTTLCP DAATCTANCA FDGADYEGTY GITSSGDSLK LSFVTGSNVG SRTYLMDSET TYKEFALLGN EFTFTVDSK LPCGLNGALY FVPMDADGGM SKYPTNKAGA KYGTGYCDAQ CPQDMKFVSG GANNEGWVPD SNSANSGTGN IGSCCSEFDV WEANSMSQAL TPHTCTVDGQ TACTGDDCAG NTGVCDADGC DFNPYRMGNT TPYGSGKTID TTKPFSVVTQ FITDDGTETG TLTEIKRFYV QDDVVEQPN SDISGVSGNS ITDDFCTAQK TAFGDTDYFS QKGGMAAMGK KMADGWLVL SIWDDYNVNM LWLDSDYPTDK KDASTPGVSR GSCATTSGVP ATVEAASGSA YVTFSSIKYG PIGSTFKAPA DSSSPVVASS SPAAVAAVVS TSSAQAVPSH PAVSSSQAAV STPEAVSSAP EVPASSSAAQ SVAPTSTKPK CSKVSQSSTL ATSVAAPATT ATSAAVAATS AASSSGVPL YGNCTGGKTC SEGTCVVQNP WYSQCVASS |
| SEQ ID NO: 41 | 50402144 | Trichoderma reesei | MFRAAALLAF TCLAMVSGQQ AGTNTAENHP QLQSQQCTTS GGCKPLSTKV VLDSNWRWVH STSGYTNCYT GNEWDTSLCP DGKTCAANCA LDGADYSGTY GITSTGTALT LKFVTGSNVG KYGTGYCDSQ CPKDIKFING EANVGNWTET EFTFDVDMSN LPCGLNGALY LSAMDADGGM SKYPGNKAGA KYGTGYCDSQ CPKDIKFING EANVGNWTET GSNTGTGSYG TCCSEMDIWE ANNDAAAFTP HPCTTTGQTR CSGDDCARNT GLCDGDGCDF NSFRMGDKTF LGKGMTVDTS KPFTVVTQFL TNDNTSTGTL SEIRRIYIQN GKVIQNSVAN IPGVDPVNSI TDNFCAQQKT AFGDTNWFAQ KGGLKQMGEA LGNGMVLALS IWDDHAANML WLDSDYPTDK DPSAPGVARG TCATTSGVPS DVESQVPNSQ VVFSNIKFGD IGSTFSGTSS PNPPGGSTTS SPVTTSPTPP PTGPTVPQWG QCGGIGYSGS TTCASPYTCH VLNPYYSQCY |
| SEQ ID NO: 42 | | | MYRKLAVISA FLATARAQSA CTLQSETHPP LTWQKCSSGG TCTQQTGSVV IDANWRWTHA TNSSTNCYDG NTWSSTLCPD NETCAKNCCL DGAAYASTYG VTTSGNSLSI GFVTQSAQKN VGARLYLMAS DTTYQEFTLL GNEFSFDVDV SQLPCGLNGA LYFVSMDADG DIWEANSISE ALTPHCTTV GVSKYPTNTA GAKYGTCGYD SQCPRDLKFI NGQANVEGWE PSSNNANTGI GGHGSCCSEM DIWEANSISE ALTPHCTTV FETSGAINRY YVQNGVTFQQ GQEICEGDGC GGTYSDNRYG GTCDPDGCDW NPYRLGNTSF YGPGSSFTLD TTKKLTVVTQ KATSGMVLV MSLWDDYYAN MLWLDSTYPT NETSSTPGAV RGSCSTSSGV ERAEFGGSSF SDKGGLTQFK AKVTFSNIKF GPIGSTGNPS GGNPPGGNRG TTTTRRPATT TGSSPGPTQS HYGQCCGGIGY PAQVESQSPN | | Trichoderma reesei |

Note: The amino acid sequences shown are patent sequence listings; preserved as printed.

TABLE 1-continued

| Sequence Identifier (SEQ ID NO:) | Database Accession Number | Species of Origin | Amino acid sequence |
|---|---|---|---|
| SEQ ID NO: 42 | 115397177 | Aspergillus terreus NIH2624 | MPSTYDIYKK LLLLASPLSA SQAQQVGTSK AEVHPSLTWQ TCTSGGSCTT VNGKVVVDAN WRWVHNVDGY NNCYTGNTWD TTLCPDDETC ASNCALEGAD YSGTYGVTTS GNSLRLNFVT QASQKNIGSR LYLMEDDSTY KMFKLLNQEF TFDVDVSNLP CGLNGAVYFV SMDADGGMAK YPANKAGAKY GTGYCDSQCP RDLKFINGMA NVEGWEPSAN DANAGTGNHG SCCAEMDIWE ANSISTAYTP HPCDTPGQVM CTGDSCGGTY SSDRYGGTCD PDGCDFNSYR QGNKTFYGPG MTVDTKSKIT VVTQPLITNDG TASGTLSEIK RFYVQNGKVI PNSESTWSGV SGNSITTAYC NAQKTLFGDT DVFTKHGGME GMGAALAEGM VLVLSLWDDH NSNMLWLDSN YPTDKPSTTP GVARGSCDIS SGDPKDVEAN DANAYVVYSN IKVGPIGSTF SGSTGGGSS STTATSKTTT TSATKTTTT TKTTTTSAS STSTGGAQHW AQCGIGWTG PTTCVAPYTC QKQNDYYSQC L |
| SEQ ID NO: 43 | 154312003 | Botryotinia fuckeliana B05-10 | MISKVLAFTS LLAAARAQQA GTLTETHPP LSVSQCTASG CTTSAQSIVV DANWRWLHST TGSTNCYTGN TWDKTLCPDG ATCAANCALD GADYSGVYGI TTSGNSIKLN FVTKGANTNV GSRTYLMAAG STTQYQMLKL LNQEFTFDVD VSNLPCGLNG ALYFAAMDAD GGLSRFPTNK AGAKYGTGYC DAQCPQDIKF INGVANSVGW TPSSNDVNAG AGQYGSCCSE MDIWEANKIS AAYTPHPCSV DTQTRCTGTD CGIGARYSSL CDADGCDFNS YRQGNTSFYG AGLTVNTNKV FTVVTQFITN DGTASGTLKE IRRPYVQNGV VIPNSQSTIA GVPGNSITDS FCAAQKTAFG DTNEFATKGG LATMSKALAK GMVLVMSIWD DHTANMLWLD APYPATKSPS APGVTRGSCS ATSGNPVDVE ANSPGSSVTF SNIKWGPINS TYTGSGAAPS VPGTTTVSSA PASTATSGAG GVAKYAQCGG SGYSGATACV SGSTCVALNP YYSQCQ |
| SEQ ID NO: 44 | 49333365 | Volvariella volvacea | MPPAATLFAF SLFAAVYGQQ VGTQLAETHP RLTWQKCTRS GGCQTQSNGA IVLDANWRWV HNVGGYTNCY TGNTWNTSLC PDGATCAKNC ALDGANYQST YGITTSGNAL TLKFVTQSEQ KNIGSRVLL ESDTKYQLFN PLNQEFTFDV DVSQLPCGLN GAVYFSAMDA DGGMSKFPNN AAGAKYGTGY CDSQCPRDIK FINGEANVQG WQPSPNDTNA GTGNYGACCN EMDVWEANSI STAYTPHPCT QQGLVRCSGT ACGGGSNRYG SICDPDGCDF NSFRMGDKSF YGPGLTVNTQ QKFTVTQFL TNNNSSSGTL REIRRLYVQN GRVIQNSKVN IPGMPSTMDS VTTEFCNAQK TAFNDTFSFQ QKGGMANMSE ALRRGMVLVL SIWDDHAANM LWLDSNYPTD RPASQPGVAR GTCPTSSGKP SDVENSTANS QVIYSNIKFG DIGSTYSA |
| SEQ ID NO: 45 | 729650 | Penicillium janthinellum | MKGSISYQIY KGALLLSALL NSVSAQQVGT LTAETHPALT WSKCTAGKCS QVSGSVVIDA NMPXVHSTSG STNCYTGNTW DATLCPDDVT CAANCAVDGA RRQHLRVTTS GNSLRINFVT TASQKNIGSR LYLLENDTTY QKFNLLNQEF TFDVDVSNLP CGLNGALYFV DMDADGGMAK YPTNKAGAKY GTGYCDSQCP RDLKFINGQA NVDGWTPSKN DVNSGIGNHG SCCAEMDIWE ETIDIKSPFT VVTQPLITNDG TSTGTLSEIK RFYVQGGKVI STDRYGGTCD PDGCDFNPYR MGVTNFYGPG KITVVTQFIT DDNTSSGNLV EIRRVVYQDG VTYQNSFSTF PSLSQYNSIS SGNSITDSWC NAQKSAFGDT NEFSKHGGMA GMGAGLADGM VLVMSLWDDH ASDMLWLDST YPTNATSTTP GAKRGTCDIS RRPNTVESTY PNAYVIYSNI KTGPLNSTFT GGTTSSSSTT TTTSKSTSTS SSSKTTTTVT TTTTSSSGSG TGARDWAQCG GNGWTGPTTC VSPYTCTKQN DWYSQCL |
| SEQ ID NO: 46 | 146424871 | Pleurotus sp Florida | MPRTAALTAF TLAAVVLGQQ VGTLTAENHP ALSIQQCTAS GCTTQQKSVV LDSNWRWTHS LPVHTNCYTG NAWDASLCPD PTTCAINCAI DGADYSGTYG ITTSGNALTL RFVTNGPYSK NIGSRVLLD DADHYKMFDL KNQEFTFDVD MSGLPCGLNG ALYFSEMPAD GGKAAHTSNK TAYTPHVCRD EGLYRCSGTE CGDGDNRYGG DAQCPHDIKW INGEANILDW SASATDANAG NGRYGACCAE MDIWEANSEA TAYTPHVCRD EGLYRCSGTE CGDGDNRYGG VCDKDGCDFN STRMGDKNFL GRGKTIDTTK KITVVTQFIT DDNTSSGNLV EIRRVVYQDG VTYQNSFSTF PSLSQYNSIS DDFCVAQKTL FGDNQYNTH GGTEKMGDAM ANGMVLIMSL WSDHAAHMLW LDSDYPLDKS PSEPGVSRGA CATTTGDPDD VVANHPNASV TFSNIKYGPI GSTYGGSTPP VSSGNTSAPP VTSTTSSGPT TPTGPTGTVP KNGQCCGNGY SGPTTCVAGS TCTYSNDWYS QCL |
| SEQ ID NO: 47 | 67538012 | Aspergillus nidulans FGSC A4 | MYQRALLFSA LLSVSRAQQA GTAQEVHPS LTWQRCEASG SCTEVAGSVV LDSNWRWTHS VDGYTNCYTG NEWDATLCPD NESCAQNCAV DGADYEATYG TSMDADGGLS KYEGNTAGAK YGTGYCDSQC RVYLMEDDET YQMFDLLNNE FTFDVDVSNL PCGLNGALYF GTCCPEMDIW EANSISTAYT PHPCDSVEQT MCEGDSCGGT PRDIKFINGL GNVEGWEPSD SDANAGVGGM GTCCPEMDIW EANSISTAYT PHPCDSVEQT MCEGDSCGGT YSDDRYGGTC GNVEGWEPSD RMGNTSFYGP GAIIDTSKF TVVTQPIADG GSLSIKRFY VQNGEVIPNS ESNISGVEGN SITSEFCTAQ |

TABLE 1-continued

| Sequence Identifier (SEQ ID NO:) | Database Accession Number | Species of Origin | Amino acid sequence |
|---|---|---|---|
| SEQ ID NO: 48 | 62006162 | Fusarium poae | KTAFGDEDIF AQHGGLSAMG DAASAMVLIL SIWDDHHSSM MWLDSSYPTD ADPSQPGVAR GTCEQGAGDP DVVESEHADA SVTFSNIKFG PIGSTF |
| SEQ ID NO: 49 | 146424873 | Pleurotus sp Florida | MYRAIATASA LIAAVRAQQV CSLTTETKPA LTWSKCTSSG CSNVQGSVTI DANWRWTHQV SGSTNCHTGN KWDTSVCTSG KVCAEKCCVD GADYASTYGI TSSGNQLSLS FVTKGSYGTN IGSRTYLMED ENTYQMFQLL GNEFTFDVDV SNIGCGLNGA LYFVSMDADG GKAKYPGNKA GAKYGTGYCD AQCPRDVKFI NGQANSDGWE PSKSDVNGGI GNLGTCCPEM DIWEANSIST AYTPHPCTKL TQHACTGDSC GGTYSNDRYG GTCDADGCDF NAYRQGNKTF YGPGSGFNVD TTKKVTVVTQ FHKGSNGRLS EITRLYVQNG KVIANSESKI AGNPGSSLTS DFCTTQKKVF GDIDDFAKKG AWNGMSDALE APMVLVMSLW HDHHSNMLWL DSTYPTDSTA LGSQRGSCST SSGVPADLEK NVPNSKVAFS NIKFPIGST YNKEGTQPQP TNPTNPNFTN PTNPGTVDQW GQCGGTNYSG PTACKSPFTC KKINDFYSQC Q |
| SEQ ID NO: 50 | 295937 | Trichoderma viride | MFRTAALTAF TLAAVLGQQ VGTLAAENHP ALSIQQCTAS GCTTQQKSVV LDSNWRWTHS TAGATNCYTG NAWDSSLCPN PTTCATNCAI DGAYASGTYG ITTSGNSLTL RFVTNGQYSE NIGSRVLLD DADHYKLFNL KNQEFTFDVD MSGLPCGLNG ALYFSEMAAD GGKAAHTGNN AGAKYGTGYC DAQCPHDIKW INGEANILDW SGSATDPNAG NGRYGACCAE MDIWEANSEA TAYTPHVCRD EGLYRCSGTE CGDGDNRYGG VCDKDGCDFN SYRMGDKNFL GRGKTIDTTK KITVVTQFIT DDNTPTGNLV EIRRVYVQDG VTYQNSFSTF PSLSQYNSIS DDFCVAQKTL FGDNQYNTH GGTERMGDSL ANGMVLIMSL WSDHAAHMLW LDSDYPLDKS PSEPGVSRGA CATTTGDPDD VVANHPNASV TFSNIKYGPI GSTYGGSTPP VSSGNTSVPP VTSTTSSGPT TPTGPTGTVP KWGQCGGIGY SGPTSCVAGS TCTYSNEWYS QCL |
| SEQ ID NO: 51 | 6179889 # | Alternaria alternata | MYQKLALISA FLATARAQSA CTLQAETHPP LTWQKCSSGG TCTQQTGSVV IDANWRWTHA TNSSTNCYDG NTWSSTLCPD NETCAKNCCL DGAAYASTYG VTTSADSLSI GFVTQSAQKN VGARLYLMAS DTTYQEFTLL GNEFSFDVDV SQLPCGLNGA LYFVSMDADG GVTKYPTNTA GAKYGTGYCD SQCPRDLKFI NGQANVEGWE PSSNNANTGI GGHGSCCSEM DIWEANSISE ALTPHPCTTV GQEICEGDSC GGTYSGDRYG GTCDPDGCDW NPYRLGNTSF YGPGSSFTLD TTKKLTVVTQ FETSGAINRY YVQNGVTFQQ PNAELGDYSG NSLDDDYCAA ERAEFGGSSF SDKGGLTQFK KATSGMVLV MSLWNDDYYAN MLWLDSTYPT DETSSTPGAV RGSSSTSSGV PAQLESNSPN AKVVYSNIKF GPIGSTGNPS GGNPPGGNPP GTTTPRPATS TGSSPGPTQT HYGQCCGIGY IGPTVCASGS TCQVLNPYYS QCL |
| SEQ ID NO: 52 | 119483864 | Neosartorya fischeri NRRL 181 | MTWQSCTAKG SCTNKNGKIV IDANWRWLHK KEGYDNCYTG NEWDATACPD NKACAANCAV DGADYSGTYG ITAGSNSLKL KPITKGSYST NIGSRTYLMK DDTTYEMFKF TGNQEFTFDV DVSNLPCGFN GALYFVSMDA DGGLKKYSTN KAGAKYGTGY CDAQCPRDLK FINGEGNVEG WKPSSNDANA GVGGHGSCCA EMDIWEANSV STAVTPHSCS TIEQSRCDGD GCGGTYSADR IAQPASAVPG YAGVCDPDGC DFNSYRMGVK DFYGKGKTVD TSKKFTVVTQ FIGTGDAMEI KRFYVQNGKT TYPTDKNPDT VEGNSITTKF CDQQKAVFGD TYTFKDKGGM ANMAKALANG MVLVMSLWDD HYSNMLWLDS SQHADATVVY TSSGVPADVE SNIKFGPLNS TFG |
| SEQ ID NO: 53 | 85083281 | Neurospora crassa OR74A | MASAISFQVY RSALILSAFL PSITQAQQIG TYTTETHPSM TWETCTSGGS CATNQGSVVM DANWRVHQV GSTTNCYTGN TWDTSICDTD ETCATECAVD GADYESTYGV TTSGSQIRLN FVTQNSNGAN VGSRLYMMAD NTHYQMFKLL NQEFTFDVDV SNLPCGLNGA LYFVSMDEDG GVSKYPNNKA GAQYGVGYCD SQCPRDLKFI GGTYSSDRYA QQGANVEGWT PSSNNENTGL GNYGSCCAEL DIWESNSISQ ALTPHPCDTA TNTMCTGDAC ALTPHPCDTA SEIRRYYVQN GVTYAQPDSD GTCDPDGCDF NPYRMGNTTF YGPGKTIDTN SPFTVVTQFI TDDGTDTGTL STGMVLVMSL WDDYYADMLW LDSTYPTNAS ISGITGNAIN ADYCTAENTV FDGPGTFAKH GGFSAMSEAM IESESPDSYV TYSNIKVGPI GSTPSSGSGS GSSGSGSGS ASTSTSTKT SSTPGAVRGS CSTDSGVPAT AQHYSQCGGQ DWTGPTTCVS PYTCQVQNAY YSQCL TAATSTSTAV |
| SEQ ID NO: 53 | 85083281 | Neurospora crassa OR74A | MKAYFEYLVA ALPLLGLATA QQVGKQTTET HPKLSWKKCT GKANCNTVNA EVVIDSNWRW LHDSSGKNCY DGNKWTSACS SATDCASKCQ LDGANYGTTY GASTSGDALT LKFVTKHEYG NGASKYQMFT LMNNEFAFDV DLSTVECGLN AALYFVAMEE DGGMASYSSN KAGAKYGTGY CDAQCARDLK FVGGKANIEG WTPSTNDANA GVGPYGGCCA EIDVWESNAH SFAFTPHACK TNKYHVCERD NCGGTYSEDR FAGLCDANGC TABLE 1-continued

| Sequence Identifier (SEQ ID NO:) | Database Accession Number | Species of Origin | Amino acid sequence |
|---|---|---|---|
| SEQ ID NO: 54 | 3913803 | Cryphonectria parasitica | DYNPYRMGNT DFYGKGKTVD TSKKFTVVSR FEENKLTQFF VQNGQKIEIP GPKWDGIPSD NANITPEFCS AQFQAFGDRD RFAEVGFAQ LNSALRMPMV LVMSIWDDHY ANMLWLDSVY PPEKEGOPGA ARGDCPQSSG VPAEVESQYA NSKVVYSNIR FGPVGSTVNV |
| SEQ ID NO: 55 | 60729633 | Corticium rolfsii | MFSKFALTGS LLAGAVNAQG VGTQQTETHP QMTWQSCTSP SSCTTNQGEV VIDSNWRWVH DKDGYVNCYT GNTWNTTLCP DDKTCAANCV LDGADYSSTY GITTSGNALS LQPVTQSSGK NIGSRTYLME SSTKYHLFDL IGNEFAFDVD LSKLPCGLNG ALYFVTMDAD GGMAKYSTNT AGAEYGTGYC DSQCPRDLKF INGQGNVEGW TPSTNDANAG VGGLGSCCSE MDVWEANSMD MAYTPHPCET AAQHSCNADE CGGTYSSSRY AGDCDPDGCD WNPFRMGNKD FYGSGDTVDT SQKFTVVTQF HGSGSSLTEI SQYYIQGGTK IQQPNSTWPT LTGYNSITDD FCKAQKVEFN DTDVFSEKGG LAQMGAGMAD DHYANMLWLD STYPVDADAS SPGKQRGTCA TTSGVPADVE SSDASATVIY SNIKFGPIGA TY |
| SEQ ID NO: 56 | 39971383 | Magnaporthe grisea 70-15 | MFPAAALLSF TLLAVASAQQ IGTNTAEVHP SLTVSQCTTS GGCTSSTQSI VLDANWRWLH STSGYTNCYT GMQMNSDLCP DPDTCATNCA LDGASYESTY GISTDGNAVT LNFVTQGSQT NVGSRVVLLS DDTHYQTFSL LNKEFSFDVD ASNIGCGING AVYFVQMDAD GGLSKYSSNK AGAQYGTGYC DSQCPQDIKF INGEANLLDW NATSANSGTG SYGSCCPEMD IWEANKYAAA YTPHPCSVSG QTRCTGTSCG AGSERYDGYC DKDGCDFNSW RMGNETFLGP GMTIDTNKKF TIVTQFITDD NTANGTLSEI RRLYVQGGTV IQNSVANQPN IPKVNSITDS FCTAQKTEFG DQDYFGTIGG LSQMGKAMSD MVLVMSIWDD YDAEMLWLDS NYPTSGSAST PGISRGPCSA TSGLPAITVES QQASASVTYS NIKWGDIGST YSGSGSSGSS SSSSSAASA STSTHTSAAA TATSSAAAAT GSPVPAYQGC GGQSYTGSTT CASPVVCKVS NAAYSQCLPA |
| SEQ ID NO: 57 | 39973029 | Magnaporthe grisea 70-15 | MKRALCASLS LLAAAVAQQV GTNEPEVHPK MTWKKCSSGG SCSTVNGEVV IDGNWRWIHN IGGYENCYSG NKWTSVCSTN ADCATKCCAME GAKYQETYGV FVQQNSSGKN VGSRMYLMNG ANKYQMFTLK NNEFAFDVDL SSVECGMNSA LYFVPMKEDG GMSTEPNNKA GAKYGTGYCD AQCCARDLKFI GGKGNIEGWQ PSSTDSSAGI GAQGACCAEI DIWESNKNAF AFTPHPCENN NKYHVCQDSN CGGTYSDDRF GGCDANGCD NPYRMGNPDF YGPGKTIDTN RKFTVLSRFE EYHVCTEPNC DGVAHRIPGP KPDGLEGETG ELNEQFCTDQ FTVFDERNRF NEVGGWSKLN AAYEIPMVLV MLWLDSTYPP EKAGQPGSAR GPCPADGGDP NGVVNQYPNA KVIWSNVRFG PIGSTYQVD |
| SEQ ID NO: 58 | 1170141 | Fusarium oxysporum | MQLTKAGVFL GALMGGAAAQ QVGTQTAENH PKMTWKKCTG KASCTTVNGE VVIDANWRWL HDASSKNCYD GNRMTDSCRT ASDCAAKCSL EGADYAKTYG ASTSGDALSL KFVTRHDYGT NIGSRFYLMN GASKYQMFSL LGNEFAFDVD LSTIECGLNS ALYFVAMEED GGMKSYSSNK AGAKYGTGYC DAQCARDLKF VGGKANIEGW KPSSNDANAG VGPYGACCAE IDVWESNAHA FAFTPHPCTD NKYHVCQDSN CGGTYSDDRF AGKCDANGCD INPYRLGNTD FYGKGKTVDT SKKFTVVTRF ERDALTQFFV QNNKRIDMPS PALEGLPATG AITAEYCTNV FNVFGDRNRF DEVGGWSQLQ QALSLPMVLV MSIWDDHYSN MLWLDSVYPP DKEGSPGAAR GDCPQDSGVP SEVESQIPGA TVVWSNIRFG PVGSTVNV |
| SEQ ID NO: 59 | 121710012 | Aspergillus clavatus NRRL 1 | MYRIVATASA LIAAARAQQV CSLNTETKPA LTWSKCTSSG CSDVKGSVVI DANWRWTHQT SGSTNCYTGN KWDTSICTDG KTCAEKCCLD GADYSGTYGI TSSGNQLSLG FVTNGPYSKN IGSRTYLMEN ENTYQMFQLL GNEFTFDVDV SGIGCGLNGA PHFVSMDEDG GKAKYSGNKA TQHSCTGDSC GGTYSSDRYG GTCDADGCDF PSDSDVNAGV GNLGTCCPEM DIWEANSIST AFPTHPCTKL FHKGSNGRLS EITRLYVQNG KVIANSEKI AGNPGSSLTS NAYRQGNKTF YGPGSNFNID TTKKMTVVTQ GWNGMSDALS APMVLVMSLW HDHHSNMLWL DSTYPTDSTK VGSQRGSCAT DFCSKQKSVF GDIDDFSKKG DVPNSKVSFS NIKFGPIGST YKSDGTTPNP PASSSTTGSS TPTNPPAGSV DQWGQCGGQN TSGKPSDLER FTCKKINDFY SQCQ YSGPTTCKSP |
| SEQ ID NO: 60 | | | MYQRALLFSA LATAVSAQQV GTQKAEVHPA LTWQKCTAAG SCTDQKGSVV IDANWRWLHS TEDTTNCYTG NEWNAELCPD NEACAKNCAL DGADYSGTYG VTADGSSLKL NFVTSANVGS RLYLMEDDET YQMFNLLNNE FTFDVDVSNL PCGLNGALYF VSMDADGGLS KYPGNKAGAK YGTGYCDSQC PRDLKFINGE ANVEGWKPSD NDKNAGVGGY GSCCPEMDIW EANSISTAYT PHPCDGMEQT RCDGNDCCGT YSSTRYAGTC DPDGCDFNSF |

TABLE 1-continued

| Sequence Identifier (SEQ ID NO:) | Database Accession Number | Species of Origin | Amino acid sequence |
|---|---|---|---|
| SEQ ID NO: 60 | 17902580 | Penicillium funiculosum | RMGNESFYGP GGLVDIKSPI TVVTQFVTAG GTDSGALKEI RRYVVQQGKV IGNSASNVAG VEGDSITSDF CTAQKKAFGD EDIFSKHGGL EGMGKALNKM ALIVSIWDDH ASSMMWLDST YPVDADASTP GVARGTCEHG LGDPETVESQ HPDASVTFSN IKFGPIGSTY KSV<br>MSALNSFNMY KSALILGSLL ATAGAQQIGT YTAETHPSLS WSTCKSGGSC TTNSGAITLD ANWRWVHGVN TSTNCYTGNT WNTAICDTDA SCAQPDCALDG ADYSGTYGIT TSGNSLRLNF VTGSNVGSRT YLMADNTHYQ IPFDLLNQEFT FTVDVSNLPC GLNGALYFVT MDADGGVSKY PNNKAGAQYG VGYCDSQCPR DLKFIAGQAN VEGWTPSTNN SNTGIGNHGS CCAELDIWEA NSISEALTPH PCDTPGLTVC TADDCGGTYS SNRYAGTCDP DGCDFNPYRL GVTDFYGSGK TVDTIKPFTV VTQFVTDDGT SSGSLSEIRR YVVQNGVVIP QPSSKISGIS GNVINSDFCA AELSAFGETA SFTNHGGLKN MGSALEAGMV LVMSLWDDYS VNMLWLDSTY PANETGTPGA ARGSCPTTSG NPKTVESQSG SSYVVFSDIK VGPPNSTFSG GTSTGGSTTT TASGTTSTKA STTSTSSTST GTGVAAHWGQ CGGQGWTGPT TCASGTTCTV VNPYYSQCL |
| SEQ ID NO: 61 | 1346226 | Humicola grisea var thermoidea | MRTAKFATLA ALVASAAAQQ ACSLITERHP SLSWNKCTAG GQCQTVQASI TLDSNWRWTH QVSGSTNCYT GNKWDTSICT DAKSCAQNCC VDGADYTSTY GITTNGDSLN LKFVTKGQHS TNVGSRTYLM DGEDKYQTFE LLGNEFTFDV DVSNIGCGLN GALYFVSMDA DGGLSRYPGN KAGAKYGTGY CDAQCPRDIK FINGEANIEG WTGSTNDPNA GAGRYGTCCS EMDIWEANNM ATAFTPHPCT IIGQSRCEGD SCCGTYSNER YAGVCDPDGC DFNSYRQGNK TFYGKGMTVD TTKKITVVTQ FLKDANGDLG EIKRFYVQDG KIIPNSESTI PGVEGNSITQ DWCDRQKVAF GDIDDFNRKG GMKQMGKALA GPMVLVMSIW DDHASNMLWL DSTFPVDAAG KPGAERGACP TTSGVPAEVE AEAPNSNVF SNIRFGPIGS TVAGLPGAGN GGNNGGNPPP PTTTTSSAPA TTTTASAGPK AGRMQQCCGI GFTGPTQCEE PYICTKLNDW YSQCL |
| SEQ ID NO: 62 | 156712282 | Chaetomium thermophilum | MMYKKFAALA ALVAGASAQQ ACSLTAENHP SLTWKRCTSG GSCSTVNGAV TIDANWRWTH TVSGSTNCYT GNQMDTSLCT DGKSCAQTCC VDGADYSSTY GITTSGDSLN LKFVTKHQYG TNVGSRVYLM ENDTKYQMFE LLGNEFTFDV DVSNLGCGLN GALYFVSMDA DGGMSKYSGN KAGAKYGTGY CDAQCPRDIK FINGEANVGN WTPSTNDANA GFGRYGSCCS EMDVWEANNM ATAFTPHPCT TVGQSRCEAD TCGGTYSSDR YAGVCDPDGC DFNAYRQGDK TFYGKGMTVD TNKKMTVVTQ FHKNSAGVLS EIKRFYVQDG KIIANAESKI PGNPGNSITQ EYCDAQKVAF SNTDDFNRKG GMAQMSKALA GPMVLVMSVW DDHYANMLWL DSTYPIDQAG APGAERGACP TTSGVPAEIE AQVPNSNVIF SNIRFGPIGS TVPGLDGSNP GNPTTTVVPP ASTSTSRPTS STSSPVSTPT GQPGGCTTQK WGQCGGIGYT GCTNCVAGTT CTQLNPWYSQ CL |
| SEQ ID NO: 63 | 169768818 | Aspergillus oryzae RIB40 | MASLSLSKIC RNALILSSVL STAQQGQVGT YQTETHPSMT WQTCGNGGSC STNQGSVVLD ANWRWVHQTG SSSNCYTGNK WDTSYCSTND ACAQKCALDG ADYSNTYGIT TSGSEVRLNF VTSNSNGKNV GSRVYMMADD THYEVYKLLN QEFTFDVDVS KLPCGLNGAL YFVVMDADGG VSKYPNNKAG AKYGTGYCDS QCPRDLKFIQ GQANVEGWVS STNNANTGTG NHGSCCAELD IWEANSISQA LTPHPCDTPT NTLCTGDACG GTYSSDRYSG TCDPDGCDFN PYRVGNTTFY GPGKTIDTNK PITVVTQFIT DDGTSSGTLS EIKRFYVQDG VTYPQPSADV SGLSGNTINS EYCTAENTLF GLAGMGEAMS TGMVLVMSLW DDYYANMLWL DSNYPTNEST SKPGVARGTC STSSGVPSEV EASNPSAYVA YSNIKVGPIG STFKS |
| SEQ ID NO: 64 | 46241270 | Gibberella pulicaris | MYPRAIATASA LIAAVRAQQV CSLITPETKPA LSWSKCTSSG CSNVQGSVTI DANWRWTHQL SGSTNCYTGN KWDTSICTSG KVCAEKCCID GAEYASTYGI TSSGNQLSLS FVTKGAYGTN IGSRTYLMED ENTYQMFQLL GNEFTFDVDV SNIGCGLNGA LYFVSMDADG GKAKYPGNKA GAKYGTGYCD AQCPRDVKFI NGQANSDGWQ PSKSDVNAGI GNMGTCCPEM DIWEANSIST AYTPHPCTKL TQHSCTGDSC GGTYSNDRYG GTCDADGCDF NAYRQGNKTF YGPGSGFRNVD TTKKVTVVTQ FHKGSNGRLS EITRLYVQNG KVIANSESKI AGVPGSSLTP EFCTAQKVF GDTDDFAKKG AWSGMSDALE APMVLVMSLW HDHHSNMLWL DSTYPTDSTK LGAQRGSCST SSGVPADLEK NVPNSKVAFS NIKFGPIGST YKEGVPEPTN PTNPTNPTNP TNPGTVDQWA QCGGTNYSGP TACKSPFTCK KINDFYSQCQ |
| SEQ ID NO: 65 | 49333363 | Volvariella volvacea | MPFKSSLLVL SFLATAYAQQ VGTQTAEVHP SLNWARCTSS GCTNVAGSVT LDANWRWLHT TSGYTNCYTG NSWNTTLCPD GATCAQNCAL DGANYQSTCG ITTSGNALTL KFVTQGEQKN IGSRVYLMAS ESRYEMFGLL |

TABLE 1-continued

| Sequence Identifier (SEQ ID NO:) | Database Accession Number | Species of Origin | Amino acid sequence |
|---|---|---|---|
| SEQ ID NO: 66 | 46395332 | Irpex lacteus | NKEFTFDVDV SNLPCGLNGA LYFSSMDADG GMAKNPGNKA GAKYGTGYCD SQCPRDIKFI NGEANVAGWN GSPNDTNAGT GNWGACCNEM DIWEANSISA AYTPHPCTVQ GLSRCSGTAC GTNDRYGTVC DPDGCDFNSY RMGDKTYYGP GGTGVDTRSK FTVVTQFLTN NNSSSGTLSE IRRLYVQNGR VVQNSKVNIP GMSNTLDSIT TGFCDSQKTA FGDTRSFQNK GGMSAMGQAL GAGMVLVLSV WDDHAANMLW LDSNYPVDAD PSKPGIARGT CSTTSGKPTD VEQSAANSSV TFSNIKFGDI GTTYTGGSVT TTPGNPGTTT STAPGAVQTK WGQCGQGWT GPTRCESGST CTVVNQWYSQ CI |
| SEQ ID NO: 67 | 50844407 # | Chaetomium thermophilum var thermophilum | MFRKAALLAF SFLAIAHGQQ VGTNQAENHP SLPSQHCTAS GCTTSSTSVV LDANWRWVHT TTGYTNCYTG QTWDASICPD GVTCAKACAL DGADYSGTYG ITTSGNALTL QFVKGTNVGS RVYLLQDASN YQLFKLINQE FTFDVDMSNL PCGLNGAVYL SQMDQDGGVS RFPTNTAGAK YGTGYCDSQC PRDIKFINGE ANVAGMTGSS SDPNSGTGNY GTCCSEMDIW EANSVAAAYT PHPCSVNQQT RCTGADCGQD ANRYKGVCDP DGCDFNSFRM GDQTFLGKGL TVDTSRKFTI VTQFISDDGT SSGNLAEIRR FVYQDGKVIP NSKVNIAGCD AVNSITDKFC TQQKTAFGDT NRFADQGGLK QMGAALKSGM VLALSLWDDH AANMLWLDSD YPTTADASKP GVARGTCPNT SGVPKDVESQ SGSATVTYSN IKWGDLNSTF SGTASNPTGP SSSPSGPSSS SSSTAGSQPT QPSSGSVAQW GQCGGIGYSG ATGCVSPYTC HVVNPYYSQC Y |
| SEQ ID NO: 67 | 50844407 # | Chaetomium thermophilum var thermophilum | TETHPRLTWK RCTSGGNCST VNGAVTIDAN WRWTHTVSGS TNCYTGNEWD TSICSDGKSC AQTCCVDGAD YSSTYGITTS GDSLNLKFVT KHQHGTNVGS RVYLMENDTK YQMFELLGNE FTFDVDVSNL GCGLNGALYF VSMDADGGMS KYSGNKAGAK YGTGYCDAQC PRDLKFINGE ANIENWTPST NDANAGFGRY GSCCSEMDIW EANNMATAFT PHPCTIIGQS RCEGNSCGGT YSSERYAGVC DPDGCDFNAY ROGDKTFYGK GMTVDTTKKM TVVTQFHKNS AGVLSEIKRF YVQDGKIIAN AESKIPGNPG NSITQEWCDA QKVAFGDIDD FNRKGGMAQM SKALEGPMVL VMSWDDHYA NMLWLDSTYP IDKAGTPGAE RGACPTTSGV PAEIEAQVPN SNVIFSNIRF GPIGSTVPGL DGSTPSNPTA TVAPPTSTTT SVRSTTTQIS TPTSQPGGCT TQKWGQCGGI GYTGCTNCVA GTTCTELNPW YSQCL |
| SEQ ID NO: 68 | 4586347 | Irpex lacteus | MFHKAVLVAF SLVTIVHGGQ AGTQTAENHP QLSSQKCTAG GSCTSASTSV VLDSNMRWVH TTSGYTNCYT GNTWDASICS DPVSCAQNCA LDGADYAGTY GITTSGDALT LKFVTGSNVG SRVYLMEDET NYQMFKLMNQ EFTFDVDVSN LPCGLNGAVY FVQMDQDGST SKFPNNKAGA KFGTGYCDSQ CPQDIKFING EANIVDWTAS AGDANSGTGS FGTCCQEMDI WEANSISAAY TPHPCTVTEQ TRCSGSDCGQ GSDRFNGICD PDGCDFNSFR MGNTEFYGKG LTVDTSQKFT IVTQFISDDG TADGNLAEIR RFYVQNGKVI PNSVVQITGI DPVNSITEDF CTQQKTVFGD TNNFAAKGGL KQMGEAVKNG MVLALSLWDD YAAQMLWLDS DYPTTADPSQ PGVARGTCPT TSGVPSQVEG QEGSSSVIYS NIKFGDLNST FTGTLTNPSS PAGPPVTSSP SEPSQSTQPS QPAQPTQPAG TAAQWAQCGG MGFTGPTVCA SPFTCHVLNP YYSQCY |
| SEQ ID NO: 69 | 3980202 | Phanerochaete chrysosporium | MFRAAALLAF TCLAMVSGQQ AGTNTAENHP QLQSQQCTTS GGCKPLSTKV VLDSNMRWVH STSGYTNCYT GNEWNTSLCP DGKTCAANCA LDGADYSGTY GITSTGTALI LKFVTGSNVG SRVYLMADDT HYQLLKLLNQ EFTFDVDMSN LPCGLNGALY LSAMDADGGM SKYPGNKAGA KYGTGYCDSQ CPKDIKFING EANVGNWTET GSNTGTGSYG TCCSEMDIWE ANNDAAAFTP LTNDNTSTGT LSEIRRIYIQ HPCTTTGQTR CSGDDCARNT GLCDHGDGCD FNSFRMGDKT FLGKGMTVDT SKPFTDVTQF QKGGLKQMGE ALGNGMVLAL SIWDDHAANM NGKVIQNSVA LWLDSDYPTD ITDNFCAQQK KDPSAPGVAR GTCATTSGVP TAPGDTNWFA QKGGLKQMGE ALGNGMVLAL SIWDDHAANM LWLDSDYPTD KDPSAPGVAR GTCATTSGVP SDVESQVPNS QVVFSNIKFG DIGSTFSGTS SNPPGGSTT SSPVTTSPTP PPTGPTVPQW GQCGGIGYSG STTCASPYTC HVLNPYYSQC Y |
| SEQ ID NO: 70 | 27125837 | Melanocarpus albomyces | MMMKQYLQYL AAALPLVGLA AGQRAGNETP ENHPPLTWQR CTAPGNCQTV NAEVVIDANW RWLHDDNMQN CYDGNQWTNA CSTATDCAEK CMIEGAGDYL GTYGASTSGD ALTLKFVTKH EYGTNVGSRF YLMNGPDKYQ MFNLMGNELA FDVDLSTVEC GINSALYFVA MEEDGGMASY PSNQAGARYG TGYCDAQCAR DLKFVGGKAN IRGWKSSTSD PNAGVGPYGS CCAEIDVWES NAYAFAFTPH ACTTNEYHVC ETTNCGGTYS EDRFAGKCDA NGCDYNPYRM GNPDFYGKGK TLDTSRKFTV VSRFEENKLS QYFIQDGRKI EIPPPTWEGM PNSSEITPEL CSTMFDVFND RNRFEEVGGF EQLNNALRVP MVLVMSIWDD HYANMLWLDS IYPPEKEGQP GAARGDCPTD SGVPAEVEAQ FPDAQVVWSN IRFGPIGSTY DF |

TABLE 1-continued

| Sequence Identifier (SEQ ID NO:) | Database Accession Number | Species of Origin | Amino acid sequence |
|---|---|---|---|
| SEQ ID NO: 71 | 171696102 | Podospora anserina | MYRSATPLTF ASLVLGQQVG TYTAERHPSM PIQVCTAPGQ CRESTEVVL DANWRWTHIT NGYTNCYTGN ENNATACPDG ATCAKNCAVD GADYSGTYGI TTPSSGALRL QFVKKNDNGQ NVGSRVLMA SSDKYKLFNL LNKEFTFDVD VSKLPCGLNG AVYFSEMLED GGLKSFSGNK AGAKYGTGYC DSQCPQDIKF INGEANVEGW GGADGNSTG KYGICCAEMD IWEANSDATA YTPHVCSVNE QTRCEGVDCG AGSDRYNSIC DKDGCDFNSY RLGNREFYGP GKTVDTTRPF TIVTQFVTDD GTDSGNLKSI HRYYVQDGNV IPNSVTEVAG VDQTNFISEG FCEQQKSAFG DNNYFGQLGG MRAMGESLKK MVLVLSIWDD HAVNMNWLDS IFPNDADPEQ PGVARGRCDP ADGVPATIEA AHPDATVIYS NIKFGAINST FTAN |
| SEQ ID NO: 72 | 3913802 | Cochliobolus carbonum | MYRTLAFASL SLYGAARAQQ VGTSTAENHP KLTWQTCTGT GGTNCSNKSG SVVLDSNWRW AHNVGGYTNC YTGNSWSTQY CPDGDSCTKN CAIDGADYSG TYGITTSNNA LSLKFVTKGS FSSNIGSRTY LMETDTKYQM FNLINKEFTP DVDVSKLPCG LNGALYFVEM AADGIGKGN NKAGAKYTG YCDSQCPHDI KFINGKANVE GWNPSDADPN GGAGKIGACC PEMDIWEANS ISTAYTPHPC RGVGLQECSD AASCGDGSNR YDGQCDKDGC DFNSYRMGVK DFYGPGATLD TTKKMTVITQ FLGSGSSLSE IKRFYVQNGK VKNSQSAVA GVTGNSITES FCTAQKKAFG DTSSFAALGG LNEMGASLAR GHVLIMSLWG DHAVNMLWLD STYPTDADPS KPGAARGTCP TTSGKPEDVE KNSPDATVVF SNIKFGPIGS TFAQPA |
| SEQ ID NO: 73 | 50403723 | Trichoderma viride | MYQKLALISA FLATARAQSA CTLQAETHPP LTWQKCSSGG TCTQQTGSVV IDANWRTHA TNSSTNCYDG NTWSSTLCPD NETCAKNCCL DGAAYASTYG VTTSADSLSI GFVTQSAQKN VGARLYLMAS DTTYQEFTLL GNEFSFDVDV SQLPCGLNGA LYFVSMDADG GVSKYPTNTA GAKYGTGYCD SQCPRDLKFI NGQANVEGWE PSSNNANTGI GGHGSCCSEM DIWEANSISE ALTPHPCTTV GQEICDGDSC GGTYSGDRYG GTCDPDGCDW NPYRLGNTSF YGPGSSFTLD TTKKLTVVTQ FETSGAINRY YVQNGVTFQQ PNAELGDYSG NSLDDDYCAA ERAEFGGSSF SDKGGLTQFK KATSGMVLV MSLWNDDYYAN MLWLDSTYPT NETSSTPGAV RGSCSTSSGV PAQLESNSPN AKVVYSNIKF GPIGSTGNSS GGNPPGGNPP GTTTRRPAT STGSSPGTQ THYGQCGGIG YSGPTVCASG STCQVLNPYY SQCL |
| SEQ ID NO: 74 | 3913798 | Aspergillus aculeatus | MVDSFSIYKT ALLLSMLATS NAQQVGTYTA ETHPSLTWQT CSSGGSCTTT SGSVVIDANW RWVHEVGGYT NCYSGNTWDS SICSTDTTCA SECALEGATY ESTYGVTTSG SSLRLNFVTT ASQKNIGSRL YLLADDSTYE TFKLFNREFT FDVDVSNLPC GLNGALYFVS MDADGGVSRF PTNKAGAKYG TGYCDSQCPR DLKFIDGQAN IEGWEPSSTD VNAGTGNHGS CCPEMDIWEA NSISSAFTAH PCDSVQQTMC TGDTCGGTYS DTTDRYSGTC DPDGCDFNPY RFGNTNFYGP GKTVDNSKPF TVVTQFITHD GTDTGTLTEI RRLYVQNGVV IGNGPSTYTA ASGNSITESF CKAEKTLFGD TNVFETHGGL SAMGDALGDG MVLVLSLWDD HAADMLWLDS DYPTTSCASS PGVARGTCPT TTGNATYVEA NYPNSYVTYS NIKFGTLNST YSGTSSGGSS SSSTTLTTKA STSTTSSKTT TTTSKTSTTS SSSTNVAQLY GQCGGQGWTG PTTCASGTCTKQNDYYSQCL |
| SEQ ID NO: 75 | 66828465 | Dictyostelium discoideum | MYIRILKSFIL LSLVNMSLSQ KIGKLTPEVH PPMTFQKCSE GGSCETIQGE VVVDANWRWV HSAQGQNCYT GNTWNPTICP DDETCAENCY LDGANYESVY GVTTSEDSVR LNFVTQSOQGK DAQCPRDLKF NIGSRLFLMS NESNYOLFHV LGQEFTFDVD VSNLDCGLNG ALYLVSMDSD GGSARFPTNE TAVTPHPCDT SSOSVCKSDS CGGAASNRY GGICDPDGCD ISGSANVDGW IPSTNNPNTG YGNLGSCCAE MDLWEANNMA NSVITVVTQF ITDDGSSSDGK LTSIKRLVQ DGNVISQSVS TIDGVGNEV YNPYRMGNTS FFGPNKMIDT KVEQNYPNAY VVYSNIKVGP WLDSSYPTTS SPTDPGVARG NEEFCTNQKK VFGDEDSFTK HGGLAKMGEA LKDGMVLVLS SCPTTSGVPS IDSTYKK |
| SEQ ID NO: 76 | 156060391 | Sclerotinia sclerotiorum 1980 | MISRVLAISS LLAAARAQQI GTNTAEVHPA LTSIVIDANW RWLHTTSGYT NCYTGNSWDA TLCPDAVTCA ANCALDGADY SGTYGITTSG NSLKLNFVTK GANTNVGSRT YLMAAGSKTQ YOLLKLLGQE FTFDVDVSNL PCGLNGALYF AEMDADGGVS RFPTNKAGAQ YGTGYCDAQC PQDIKFINGQ ANSVGWTPSS NDVNTGTGQY GSCCSEMDIW EANKISAAYT PHPCSVDGQT RCTGTDCGIG ARYSSLCDAD GCDFNSYRMG DTGFYGAGLT VDTSKVFTVV TQFITNDGTT SGTLSEIRRF YVQNGKVIPN SQSKVTGVSG NSITDSFCAA QKTAFGDTNE FATKGGLATM SKALAKGMVL VMSIWDDHSA NMLWLDAPYP ASKSPSAAGV SRGSCSASSG VPADVEANSP |

TABLE 1-continued

| Sequence Identifier (SEQ ID NO:) | Database Accession Number | Species of Origin | Amino acid sequence |
|---|---|---|---|
| | | | GASVTYSNIK WGPINSTYSA GTGSNTGSGS GSTTLVSSV PSSTPTSTTG VPKYGQCGGS GYTGPTNCIG STCVSMGQYY SQCQ |
| SEQ ID NO: 77 | 116181754 | Chaetomium globosum CBS 148-51 | MYRQVATALS FASLVLGQQV GTLTAETHPS LPIEVCTAPG SCTKEDTVV LDANWRWTHV TDGYTNCYTG NAWNETACPD GKTCAANCAI DGAEYEKTYG ITTPEEGALR LNFVTESNVG KYGTGYCDSQ LNFVTESNVG SRVYLMAGED KYRLFNLLNK EFTMDVDVSN LPCGLNGAVY FSEMDEDGGM SRFEGNKAGA KYGTGYCDSQ CPRDIKFNG EANSEGWGGE DGNSGTGKYG TCCAEMDIWE ANLDATAYTP HPCKVTEQTR CEDDTECGAG DARYEGLCDR DGCDFNSFRL GNKEFYGPEK TVDTSKPFTL VTQFVTADGT DTGALQSIRR FYVQDGTVIP NSETVVEGVD PTNEITDDFC AQQKTAFGDN NHFKTIGGLP AMGKSLEKMV LVLSIWDDHA VYMNWLDSNY PTDADPTKPG VARGRCDPEA GVPETVERAAH PDAYVIYSNI KIGALNSTFA AA |
| SEQ ID NO: 78 | 145230535 | Aspergillus niger | MSSFQVYRAA LLLSILATAN AQQVGTYTTE THPSLTWQTC TSDGSCTTND GEVVIDANWR WVHSTSSATN CYTGNEWDTS ICTDDVTCAA NCALDGATYE ATYGVTTSGS ELRLNFVTGG SSKNIGSRLY LMSDDSNYEL FKLLGQEFTF DVDVSNLPCG LNGALYFVAM DADGTSEYS GNKAGAKYGT GYCDSQCPRD LKFINGEANC DGWEPSSNNV NTGVGDHGSC CAEMDVWEAN SISNAFTAHP CDSVSQTMCD GDSCGGTYSA SGDRYSGTCD PDGCDYNPYR LGNTDFYGPG LTVDTNSPFT VVTQFITDDG TSSGTLTEIK RLYVQNGEVI ANGASTYSSV NGSSITSAFC ESEKTLPGDE NVFDKHGGLE GMGEAMAKGM VLVLSLWDDY AADMLWLDSD YPVNSSASTP GVARGTCSTD SGVPATVEAE SPNAVVTYSN IKFGPIGSTY SGSSSSGSGS SSSSSTTTK ATSTTLKTTS TTSSGSSSTS AAQAYGQCGG QGWTGPTTCV SGYTCTYENA YYSQCL |
| SEQ ID NO: 79 | 46241266 | Nectria haematococca mpVI | MYRAIATASA LLATARAQQV CTLNTENKPA LTWAKCTSSG CSNVRGSVVV DANWRWAHST SSSTNCYTGN TWDKTLCPDG KTCADKCCLD GADYSGTYGV TSSGNQLNLK FVTVGPYSTN VGSRLVLMED ENNYQMFDLL GNEFTFDVDV NNIGCGLNGA LYFVSMDKDG GKSRFSTNKA GAKYGTGYCD TQQSCEGDAC AQCPRDVKFI NGVANSDEWK PSDSDKNAGV GKYGTCCPEM DIWEANKIST AYTPHPCKSL GGTYSNDRYA GGTYSATRYA GTCDPDGCDF NPYRQGNKTF YGPGSGFNVD TTKKVVVTQ FIKGSDGKLS EIKRLYVQNG KVIGNPQSEI ANNPGSSVTD SFCKAQKVAF NDPDDFNKKG GWSGMSDALA KPMVLVMSLW HDHYANMLWL DSTYPKGSKT PGSARGSCPE DSGDPDTLEK EVPNSGVSFS NIKFGPIGST YTGTGGSNPD PEEPEEPEP VGTVPQYGQC GGINYSGPTA CVSPYKCNKI NDFYSQCQ |
| SEQ ID NO: 80 | 1q9h (PDB) # | Talaromyces emersonii | EQAGTATAEN HPPLTWQECT APGSCTTQNG AVVLDANWRW VHDVNGYTNC YTGNTWDPTY CPDDETCAQN CALDGADYEG TYGVTSSGSS LKLNFVTGSN VGSRLYLLQD DSTYQIFKLL NREFSFDVDV SNLPCGLNGA LYFVAMDADG GVSKYPNNKA GAKYGTGYCD SQCPRDLKFI DGEANVEGWQ PSSNNANTGI GDHGSCCAEM DVWEANSISN AVTPHCDTP GQTMCSGDDC GGTYSNDRYA GTCDPDGCDF NPYRMGNTSF YGPGKIIDTT KPPTVTQFL TDDGTDTGTL SEIKRFYIQN SNVIPQPNSD ISGVTGNSIT TEFCTAQKQA FGDTDDFSQH GGLAKMGAAM QQGMVLVMSL WDDYAAQMLW LDSDYPTDAD PTTPGIARGT CPTDSGVPSD VESQSPNSYV TYSNIKFGPI NSTFTAS |
| SEQ ID NO: 81 | 157362170 | Polyporus arcularius | MFPTLALVSL SFLAIAYGQQ VGTLTAETHP KLSVSQCTAG GSCTTVQRSV VLDSNWRWLH DVGGSTNCYT GNTWDDSLCP DPTTCAANCA LDGADYSGTY GITTSGNALS LKFVTQGPYS TNIGSRVYLL SEDDSTYEMF NLKNQEFTFD VDMSALPCGL NGALYFVEMD NKAGSKYGTG YCDTQCPHDI KFINGEANVL DWAGSSNDPN AGTGHYGTCC NEMDIWEANS MGAAVTPHVC TVQGQTRCEG TDCGDGDERY DGICDKDGCD FNSWRMGDQT FLIGPGKTVDT SSKFTVVTQF ITADNTTSGD LSEIRRLVQ NGKVIANSKT QIAGMDAYDS ITDDFCNAQK TTFGDINTFE QMGGLATMGD AFETGMVLVM SIWDDHERAKM LWLDSDYPTD ADASAPGVSR GPCPTTSGDP TDVESQSPGA TVIFSNIKTG PIGSTFTS |
| SEQ ID NO: 82 | 7804885 | Leptosphaeria maculans | MLSASKAAAI LAFCAHTASA WVVGDQQTET HPKLNWQRCT GKGRSSCTNV NGEVVIDANW RMLAHRSGYT NCYTGSEWNQ SACPNNEACT KNCAIEGSDY AGTYGITTSG NQMNIKFITK RPYSTNIGAR TYLMKDEQNY EMFQLIGNEF TFDVDLSQRC GMNGALYFVS MPQKGQGAPG AKYGTGYCDA QCARDLKFVR GSANAEGWTK SASDPNSGVG KKGACCAQMD VWEANSAATA LTPHSCQPAG YSVCEDTNCG GTYSEDRYAG TCDANGCDFN PFRVGVKDFY GKGKTVDTTK KMTVVTQFVG SGNQLSEIKR FYVQDGKVIA NPEPTIPGME WCNTQKKVFQ |

TABLE 1-continued

| Sequence Identifier (SEQ ID NO:) | Database Accession Number | Species of Origin | Amino acid sequence |
|---|---|---|---|
| SEQ ID NO: 83 | 121852 | Phanerochaete chrysosporium | EERAYPFNEFG GMASMSEGMS QGMVLVMSLW DDHYANMLWL DSNWPREADP AKPGVARRDC PTSGGKPSEV EAANPNAQVM FSNIKFGPIG STFAHAA MFRTATLLAF TMAAMVFGQQ VGTNTARSHP ALTSQKCTKS GGCSNLNTKI VLDANWRWLH STSGYTNCYT GNQMDATLCP DGKTCAANCA LDGADYTGTY GITASGSSLK LQFVTGSNVG SRVYLMADDT HYQMFQLLNQ EFTFDVDMSN LPCGLNGALY LSAMDADGGM AKYPTNKAGA KYGTGYCDSQ CPRDIKFING EANVEGWNAT SANAGTGNYG TCCTEMDIWE ANNDAAAYTP HPCTTNAQTR CSGSDCTRDT GLCDADGCDF NSFRMGDQTF LGKGLTVDTS KPFTVVTQFI TNDGTSAGTL TEIRRLYVQN GKVIQNSSVK IPGIDPVNSI TDNFCSQQKT AFGDTNYPAQ HGGLKQVGEA LRTGMVLALS IWDDYAANML WLDSNYPTNK DPSTPGVARG TCATTSGVPA QIEAQSPNAY VVFSNIKFGD LNTTYTGTVS SSSVSSSHSS TSTSSSHSSS STPPTQPTGV TVPQWQCGG IGYTGSTTCA SPYTCHVLNP YYSQCY |
| SEQ ID NO: 84 | 126013214 | Penicillium decumbens | MYQRALLFSA LMAGVSAQQV GTQKPETHPP LAWKECTSSG CTSKDGSVVI DANWRWTHSV DGYKNCYTGN EWDSTLCPDD ATCATNCAVD GADYAGTYGA TTEGDSLSIN FVTGSNIGSR FYLMEDENKY QMFKLLNKEF TFDVDVSTLP CGLNGALYFV SMDADGGMSK YETNKAGAKY GTGYCDSQCP RDLKFINGKG NVEGWKPSAN DKNAGVGPHG SCCAEMDIWE ANSISTALTP HPCDTNGQTI CEGDSCGGTY STTRYAGTCD PDGCDFNPFR MGNESFYGPG KMVDTKSKMT VVTQFITSDG TDTGSLKEIK RVYVQNGKVI ANSASDVSGI TGNSITSDFC TAQKKTFGDE DVFNKHGGLS GMGDALGEGM VLVMSLWDDH NSNMLWLDGE KYPTDAAASK AGVSRGTCST DSGKPSTVES ESGSAKVVFS NIKVGSIGST FSA |
| SEQ ID NO: 85 | 156048578 | Sclerotinia sclerotiorum 1980 | MTSKIALASL FAAAYGQQIG TYTTETHPSL TWQSCTAKGS CTTQSGSIVL DGNWRWTHST TSSTNCYTGN TWDATLCPDD ATCAQNCALD GADYSGTYGI TTSGDSLRLN FVTQTANKNV GSRVYLLADN THYKTFNLLN QEFTFDVDVS NLPCGLNGAV YFANLPADGG ISSTNKAGAQ YGTGYCDSQC PRDGKFINGK ANVDGWVPSS NNPNTGVGNY GSCCAEMDIW EANSISTAVT PHSCDTVTQT VCTGDNCGGT YSTTRYAGTC DPDGCDFNPY RQGNESFYGP GKTVDTNSVF TIVTQFLTTD GSKFTVVTQF GTSSGTLNEI KRFYVQNGKV IPNSESTISG VTGNSITTPF CTAQKTAFGD PTSFSDHGGL ASMSAAFEAG MVLVLSLWDD YYANMLWLDS TYPTTKTGAG GPRGTCSTSS GVPASVEASS PNAYVVYSNI KVGAINSTFG |
| SEQ ID NO: 86 | 156712278 | Acremonium thermophilum | MYTKFAALAA LVATVRGQAA CSLTAETHPS LQWQKCTAPG SCTTVSGQVT IDANWRWLHQ TNSSTNCYTG NEWDTSICSS DTDCATKCCL DGADYTGTYG VTASGNSLNL KFVTQGPYSK NIGSRMYLME SESKYQGFTL LGQEFTFDVD VSNLGCGLNG ALYFVSMDLD GGVSKYTTNK AGAKYGTGYC IGQTMCTGDD CGGTYSSDRY AGICDPDGCD QPSSNDANAG LGNHGSCCSE MDIWEANKVS AAYTPHPCTT IKRFYVQNGK VIPNSESKIA YSDDRYGGTC GVSGNSITTD FNSYRMGDTS FYGPGKTVDT GSKFTVVTQF LTGSDGNLSE KRFYVQNGK DHAVNMLWLD VIPNSESKIA GAARGDCPIT FCTAQKTAFG DTNVFEERGG LAQMGKALAE PMVLVLSVWD GGGTTTTTT VIPNSESKIA TTNPSGPQQT SGVPADVESQ APNSNVIYSN IRFGPINSTY TGTPSGGNPP QCL STYPTDSTKP TTSKPSGPTT HWGQCGGQGW TGPTVCQSPY TCKYSNDWYS |
| SEQ ID NO: 87 | 21449327 | Aspergillus nidulans (also known as Emericella nidulans) | MYQRALLFSA LLSVSRAQQA GTAQEVHPS LTWQRCEASG SCTEVAGSVV LDSNWRWTHS VDGYTNCYTG NEWDATLCPD NESCAQNCAV DGADYEATYG ITSNGDSLTL KFVTGSNVGS RVYLMEDDET YQMFDLLNNE FTFDVDVSNF PCGLNGALYF TSMDADGGLS KYEGNTAGAK YGTGYCDSQC PRDIKFINGL GNVEGWEPSD SDANAGVGGM GTCCPEMDIW EANSISTAYT PHPCDSVEQT MCEGDSCGGT YSDDRYGGTC DPDGCDFNSY RMGNTRFYGP GAIIDTSSKF TVVTQFIADG GSLSEIKRFY VQNGEVIPNS ESNISGVEGN SITSEFCTAQ KTAFGDEDIF AQHGGLSAMG DAASAMVLIL SIWDDHHSSM MWLDSSYPTD ADPSQPGVAR GTCEQGAGDP DVVESEHADA SVTFSNIKFG PIGSTF |
| SEQ ID NO: 88 | 171683762 | Podospora anserine (S mat+) | MMMKQYLQYL AAGSLMTGLV AGQGVGTQQT ETHPRITWKR CTGKANCTTV QAEVVIDSNW RMIHTSGGTN CVDGNAWNTA ACSTATDCAS KCLMREGAGNY QQTYGASTSG DSLTLKFVTK HEYGTNVGSR FYLMNGASKY QMFTLMNNEF TFDVDLSTVE CGLNSALYFV GCCAEIDVWE SNAHAYAFTP YPTNKAGAKY GTGYCDAQCA RDLKFVGGKA NIEGWRESSN DENAGVGPYG KTVDTTKKFT VVTRFQDDNL EQFVQNGQK HACENNNYHV CRDTCGGTY SEDRFAGGCD ANGCDYNPYR MGNPDFYGKG IPASPNLTPE |

TABLE 1-continued

| Sequence Identifier (SEQ ID NO:) | Database Accession Number | Species of Origin | Amino acid sequence |
|---|---|---|---|
| SEQ ID NO: 89 | 56718412 | Thermoascus aurantiacus var leviosporus | FCSTQFDVFT DRNRFREVGD FPQLNAALRI PMVLVMSIWA DHYANMLWLD SVYPPEKEGE PGAARGPCAQ DSVPSEVKA NYPNAKVVWS NIRFGPIGST VNV<br>MYQRALLFSF FLAAARAQQA GTVTAENHPS LTWQQCSSGG SCTTQNGKVT TSGYTNCYTG NTWDTSICPD DVTCAQNCAL DGADYSGTYG VTTSGNALRL NFVTQSSGKN IGSRLYLLQD DTTYQIFKLL GQEFTFDVDV SNLPCGLNGA LYFVAMDADG GLSKYPGNKA GAKYTGYCD SQCPRDLKFI NGQANVEGWQ PSANDPNAGV GNHGSSCCAEM DWEANSIST AVTPHPCDTP GQTMCQGDDC GGTYSSTRYA GTCDPDGCDF NPYRQGNHSF YGPGKIVDTS SKFFTVTQFI TDDGTPSGTL TEIKRFYVQN GKVIPQSEST ISGVTGNSIT TEYCTAQKAA FGDNTGFFTH GGLQKISQAL AQGMVLVMSL WDDHAANMLW LDSTYPTDAD PDTPGVARGT CPTTSGVPAD VESQNPNSYV IYSNIKVGPI NSTFTAN |
| SEQ ID NO: 90 | 15824273 | Pseudotrichonympha grassii | MPAIVLLGLT RSLGTGTNQA ENHPSLSWQN CRSGGSCTQT SGSVVLDSNW RWTHDSSLTN CYDGNEWSSS LCPDPKTCSD NCLIDGADYS GTYGITSSGN SLKLVFVTNG PYSTNIGSRV YLLKDESHYQ IFDLKNKEFT FTVDDSNLDC GLNGALYFVS MDEDGGTSRF SSNRAGAKYG TGYCDAQCPH DIKFINGEAN VENWKPQTND ENAGNGRYGA CCTEMDIWEA NKYATAYTPH ICTVNGEYRC DGSECGDTDS GNRYGGVCDK DGCDFNSYRM GNTSFWGPGL IIDTGKPVTV VTQPFTDCT DNGQLSEIRL KVYQGGKVIE NTVVNIAGMS SGNSITDDFC NEQKSAFGDT NDFEKKGGLS GLGKAPDYGM VLVLSLWDDH QVNMLWLDSI YPTDQPASQP GVKRGPCATS SGAPSDVESQ HPDSSVTFSD IRFGPIDSTY |
| SEQ ID NO: 91 | 115390801 | Aspergillus terreus NIH2624 | MHQRALLFSA LVGAVRAQQA GTLTEVHPP LTWQKCTADG SCTEQSGSVV IDSNWRWLHS TNGSTNCYTG NTWDESLCPD NEACAANCAL DGADYESTYG ITTSGDALTL TFVTGENVGS RVYLMAEDDE SYQTFDLVGN EFTFDVDVSN LPCGLNGALY FSMDADGGV SKYPANKAGA KYGTGYCDSQ CPRDLKFING MANVEGWTPS DNDKNAGVGG HGSCCPELDI WEANSISSAF TPHPCDDLGQ TMCSGDDCGG TYSETRYAGT CDPDGCDFNA YRMGNTSYYG PDKIVDTNSV MTVVTQPIGD GGSLSEIKRL YVQNGKVIAN AQSNVDGVTG NSITSDFCTA QKTAFGDQDI FSKHGGLSGM GDAMSAMVLI LSIWDDHNSS MMWLDSTYPE DADASEPVA RGTCEHGVGD PETVESQHPG ATVTFSKIKF GPIGSTYSSN STA |
| SEQ ID NO: 92 | 453223 | Phanerochaete chrysosporium | MFPRAAALLAF TCLAMYSGQQ AGTNTAENHP QLQSQOCTTS GGCKPLSTKV VLDSNMRWVH STSGYTNCYT GNEMDTSLCP DGKTCAANCA LDGADYESTG GITSTGTALT LKFVTGSNVG KYGTGYCDSQ SRVYLMADDT HYQLLKLLNQ EFTFDVDMSN LPCGLNGALY LSAMDADGGM SKYPGNKAGA KYGTGYCDSQ CSGDDCARNT CPKDIKFING EANVGNWTET GSNTGTGSYG TCCSEMDIWE ANNDAAAFTP HPCTTGQTR SGSDCTADSG GLCDGDGCDF NSFRMGDKTF LGKGMTVDTS KPFTVVTQFL TNDNTSTGTL SEIRRIYIQN GKVIQNSVAN IPGVDPVNSI TDNFCAQOKT AFGDTNWFAQ KGGLKOMGEA IWDDHAANML WLDSDYPTDK DPSAPGVARG TCATTSGVPS DVESQVPNSQ VVFSNIKFGD IGSTFSGTSS PNPPGGSTTS SPVTTSPTPP PTGPTVPQWG QCGGIGYSGS TTCASPYTCH VLNPCESILS LQRSSNADQY LQTTRSATKR RLDTALQPRK |
| SEQ ID NO: 93 | 3132 | Phanerochaete chrysosporium | MRTALALILA LAAFSAVSAQ QAGTITAETH PTLTIQQCTG SGGCAPLITK VVLDVNWRWI HSTTGYTNCY SGNTWDAILC PDPVTCAANC ALDGADYTGT FGILPSGTSV TLRPVDGLGL RLFLLADDSH YQMFQLLNKE FTFDVEMPNM RCGSSGAIHL TAMDADGGLA KYPGNQAGAK YGTGFCSAQC PKGVKFINGQ ANVEGWGLTT ATTGTGFPGS CCTDIALWEA NDNSASFAPH PCTTNSQTRC SGSDCTADSG LCDADGCNFN SFRMGNTTFF GAGMSVDTTK LFTVVTQFIT SDNTSMGALV EIHRLYIQNG QVIQNSVVNI PGINPATSIT DDLCAQENAA FGGTSSFAQH GGLAQVGEAL RSGMVLALSI VNSAADTLWL DSNYPADADP SAPGVARGTC PQDSASIPEA PTPSVVFSNI KLGDIGTTFG AGSALFSGRS PPGEVPGSAP ASSATATAPP FGSQCGGLGY AGPTGVCPSP YTCQALNIYY SQCI |
| SEQ ID NO: 94 | 16304152 | Thermoascus aurantiacus | MYQRALLFSF FLAAARAHEA GTVTAENHPS LTWQQCSSGG SCTTQNGKVT TSGYTNCYTG NTWDTSICPD DVTCAQNCAL DGADYSGTYG VTTSGNALRL NLSKYPGNKA IGSRLYLLQD DTTYQIFKLL GQEFTFDVDV SNLPCGLNGA LYFVAMDADG DWEANSIST AVTPHPCDTP GQTMCQGDDC SQCPRDLKFI NGQANVEGWQ PSANDPNAGV GNHGSSCCAEM DWEANSIST AVTPHPCDTP GQTMCQGDDC GGTYSSTRYA GTCDTDGCDF NPYQPGNHSF YGPGKIVDTS SKFFTVVTQFI TDDGTPSGTL TEIKRFYVQN GKVIPQSEST ISGVTGNSIT |

TABLE 1-continued

| Sequence Identifier (SEQ ID NO:) | Database Accession Number | Species of Origin | Amino acid sequence |
|---|---|---|---|
| SEQ ID NO: 95 | 156712280 | Acremonium thermophilum | TEYCTAQKAA FDNTGFFTHG GLQKISQALA QGMVLVMSLW DDHAANMLWL DSTYPTDADP DTPGVARGTC PTTSGVPADV ESQNPNSYVI YSNIKVGPIN STFTAN |
| SEQ ID NO: 96 | 5231154 | Volvariella volvacea | MHKRAATLSA LVVAAAGFAR GQGVGTQQTE THPKLTFQKC SAAGSCTTQN GEVVIDANWR WVHDKNGYTN CYTGNEWNTT ICADAASCAS NCVVDGADYQ GTYGASTSGN ALTLKFVTKG SYATNIGSRM YLMASPTKYA MFTLLGHEFA FDVDLSKLPC GLNGAVYFVS MDEDGGTSKY PSNKAGAKYG TGYCDSQCPR DLKFIDGKAN SASWQPSSND QNAGVGGMGS CCAEMDIWEA NSVSAAYTPH PCQNYQQHSC SGDDCGGTYS ATRFAGDCDP DGCDWNAYRM GVHDFYGNGK TVDTGKKFSI VTQFKGSGST LTEIKQFVQ DGRKIENPNA TWPGLEPFNS ITPDFCKAQK QVFGDPDRFN DMGGFTNMAK ALANPMVLVL SLWDDHYSNM LWLDSTYPTD ADPSAPGKGR GTCDTSSGVP SDVESKNGDA TVIYSNIKFG PLDSTYTAS |
| SEQ ID NO: 97 | 116200349 | Chaetomium globosum CBS 148-51 | MRASLLAPSL NSAAGQQAGT LQTKNHPSLT SQKCRQGGCP QVNTTIVLDA NMRWTHSTSG STNCYTGNTW QATLCPDGKT CAANCALDGA DYTGTYGVTT SGNSLTLQFV TQSNVGARLG YLMADDTTYQ MFNLLNQEFW FDVDMSNLPC GLNGALYFSA MARTAAWMPM VVCASTPLIS TRRSTARLLR LPVPPRSRYG RGICDSQCPR DIKFINGEAN VQGWQPSPND TNAGTGNYGA CCNKMDVWEA NSISTAYTPH PCTQRGLVRC SGTACGGGSN RYGSICDHDG LGFQNLFGMG RTRVRARVGR VKQFNRSSRV VEPISWTKQT TLHLGNLPWK SADCNVQNGR VIQNSKVNIP GMPSTMDSVT TEFCNAQKTA FNDTFSFQQK GGMANMSEAL RRGMVLVLSI WDDHAANMLW LDSITSAAAC RSTPSEVHAT PLRESQIRSS HSRQTRYVTF TNIKFGPFNS TGTTYTTGSV PTTSTSTGTT GSSTPPQPTG VTVPQGQCGG IGYTGPTTCA SPTTCHVLNP YYSQCY |
| SEQ ID NO: 98 | 4586343 | Irpex lacteus | MKQYLQYLAA ALPLMSLVSA QGVGTSTSET HPKITWKKCS SGGGCSTVNA EVVIDANWRW LHNADSKNCY DGNEWTDACT SSDDCTSKCV LEGAEYGKTY GASTSGDSLS LKFLTKHEYG TNIGSRFYLM NGASKYQMFT LMNNEFAPDV DLSTVECGLN SALYFVAMEE DGGMASYSTN KAGAKYGTGY CDAQCARDLK FVGGKANYDG WTPSSNDANA GVGALGCCA EIDVWESNAH AFAFTPHACE NNNYHVCEDT TCGGTYSEDR FAGDCDANGC DYNPYRVGNT DFYGKGMTVD TSKKFVVSQ FQENKLTQFF VQNGKKIEIP GPKHEGLPTE SSDITPELCS AMPEVFGDRD RPAEVGGFDA LNKALAVPMV LVMSIWDDHY ANMLWLDSSY PPEKAGTPGG DRGPCAQDSG VPSEVESQYP DATVWWSNIR FGPIGSTVQV |
| SEQ ID NO: 99 | 15321718 | Lentinula edodes | MFPKASLIAL SFIAAVVGQQ VGTQMAEVHP KLPSQLCTKS GCTNQNTAVV LDANWRWLHT TSGYTNCYTG NSWDATLCPD ATTCAQNCAV DGADYSGTYG ITTSGNALTL KFKTGTNVGS RVYLMQTDTA YQMFQLLNQE FTPDVDMSNL PCGLNGALYL SQMDQDGGLS KFPTNKAGAK YGTGYCDSQC PHDIKFINGM ANVAGWAGSA SDPNAGSGTL GTCCSEMDIW EANNDAAAFT PHPCSVDGQT QCSGTQCCGDD DERYSGLCDK DGCDFNSFRM GDKSFLGKGM TVDTSRKFTV VTQFVTDGT TNGDLHEIRR LVYQDGKVIQ NSVVSIPGID AVDSITDNFC AQQKSVFGDT NYFATLGGLK KMGAALKSGM VLAMSVWDDH AASMQWLDSN YPADGDATKP GVARGTCSAD SGLPTNVESQ SASASVTFSN IKWGDINTTF TGTGSTSPSS PAGPVSSSTS VASQPTQPAQ GTVAQWGQCG GTGFTGPTVC ASPFTCHVVNPYYSQCY |
| SEQ ID NO: 100 | 146424875 | Pleurotus sp Florida | MFRTAALLSF AYLAVVVGQQ AGTSTAETHP PLTWEQCTSG GSCTTQSSSV VLDSNWRWTH VVGGYTNCYT GNEWNTTVCP DGTTCAANCA LDGADYEGTY GISTSGNALT LKFVTASAQT NVGSRVLMA PGSETEYQMF NPLNQEFTFD VDVSALPCGL NGALYFSEMD ADGGLSEYPT NKAGAKYGTG YCDSQCPRDI KFIEGKANVE GWTPSSTSPN AGTGGTGICC NEMDIWEANS ISEALTPHPC TAQGGTACTG DSCSSPNSTA GICDQAGCDF NSFRMGDTSF YGPGLTVDTT SKITVVTQFI TSDNTTTGDL TAIRRIYVQN GQVIQNSMSN IAGVTPTNEI TTDFCDQQKT AFGDTNTFSE KGGLTGMGAA FSRGMVLVLS IWDDDAAEML WLDSTYPVGK TGPGAARGTC ATTSGQPDQV ETQSPNAQVV FSNIKFGAIG STFSSTGTGT GTGTGTGT GTTSSAPAA TQTKYGQCGG QGWTGATVCA SGSTCTSSGP YYSQCL |
| SEQ ID NO: 101 | | | MFRTAALTAF TFAAVLGQQ VGTLTTENHP ALSIQQCTAT GCTTQQKSVV LDSNWRWTHS TAGATNCYTG NAWDPALCPD PATCATNCAI DGADYSGTYG ITTSGNALTL RFVTNGQYSQ NIGSRVLLD DADHYKLFDL KNQEFTFDVD MSGLPCGLNG ALYFSEMAAD GGKAAHAGNN AGAKYGTGYC DAQCPHDIKW INGEANVLDW VCDKDGCDFN SASATDDNAG NGRYGACCAE MDIWEANSEA TAYTPHVCRD EGLYRCSGTE CGDGNNRYGG |

TABLE 1-continued

| Sequence Identifier (SEQ ID NO:) | Database Accession Number | Species of Origin | Amino acid sequence |
|---|---|---|---|
| SEQ ID NO: 101 | 62006158 | Fusarium venenatum | SYRMGDKNFL GRGKTIDTTK KVTVVTQFIT DNNTPTGNLV EIRRVYVQNG VVYQNSRSTF PSLSQYNSIS DEFCVAQKTL FGDNQYNTH GGTTKMGDAF DNGMVLIMSL WSDHAAHMLW LDSDYPLDKS PSEPGVSRGA CPTSSGDPDD VVANHPNASV TFSNIKYGPI GSTFGGSTPP VSSGGSSVPP VTSTTSSGTT TPTGPTGTVP KWGQCGIGY SGPTACVAGS TCTYSNDWYS QCL |
| SEQ ID NO: 102 | 296027 | Phanerochaete chrysosporium | MYRAIATASA LIAAVRAQQV CSLTPETKPA LSWSKCTSSG CSNVQGSVTI DANWRTHQL SGSTNCYTGN KWDTSICTSG KVCAEKCCID GAEYASTYGI TSSGNQLSLS FVTKGTYGTN IGSRTYLMED ENTYQMRQLL GNEFTFDVDV SNIGCGLNGA LYFVSMDADG GKAKYPGNKA AQCPRDVKFI NGQANSDGWQ PSKSDVNGGI GNLGTCCPEM DIWEANSIST AHTPHPCTKL TQHSCTGDSC GGTYSEDRYG GTCDADGCDF NAYRQGNKTF YGPGSGFNVD TTKKVTVVTQ FHKGSNGRLS EITRLYVQNG KVIANSESKI AGVPGGSLTP EFCTAQKKVF GDIDDFEKKG AWGGMSDALE APMVLVMSLW HDHHSNMLWL DSTYPTDSTK LGAQRGSCST SSGVPADLEK NVPNSKVAFS NIKFGPIGST YKEGQPEPTN PTNPNPTTPG GTVDQWQCG GTNYSGPTAC KSPFTCKKIN DFYSQCQ |
| SEQ ID NO: 103 | 154449709 | Fusicoccum sp BCC4124 | MFRTATLLAF TMAAMVFGQQ VGTNTAENHR TLTSQKCTKS GGCSNLNTKI VLDANRWLH STSGYTNCYT GNQMDATLCP DGKTCAANCA LDGADYTGTY GITASGSSLK LQFVTGSNVG SRVYLMADDT HYQMFQLLNQ EFTFDVDMSN LPCGLNGALY LSAMDADGGM AKYPTNKAGA KYGTGYCDSQ CPRDIKFING EANVEGWNAT SANAGTGNYG TCCTEMDIWE ANNDAAAYTP HPCTTNAQTR CSGSDCTRDT GLCDADGCDF NSFRMGDQTF LGKGLTVDTS KPFTVVTQFI TNDGTSAGTL TEIRRLYVQN GKVIQNSSVK IPGIDLVNSI TDNFCSQQKT AFGDTNYFAQ HGGLKQVGEA LRTGMVLALS IWDDYAANML WLDSNYPTNK DPSTPGVARG TCATTSGVPA QIEAQSPNAY VVFSNIKFGD LNTTYTGTVS SSSVSSSHSS TSTSSSHSSS STPPTQPTGV TVPQWQGCGG IGYTGSTTCA SPYTCHVLNP YYSQCY |
| SEQ ID NO: 104 | 169859460 | Coprinopsis cinerea okayama | MYQTSLLASL SFLLATSQAQ QVGTQTAETH PKLITQKCTT AGGCTDQSTS IVLDANWRWL HTVDGYTNCY TGQEMDTSIC TDGKTCAEKC ALDGADYEST YGISTSGNAL TMNFVTKSSQ TNIGGRVYLL AADSDDTYEL FKLKNQEFTF DVDVSNLPCG LNGALYFSEM DSDGLSKYT TNKAGAKYGT GYCDTQCPHD IKFINGEANV QNWTASSTDK NAGTGHYGSC CNEMDIWEAN SQATAFTPHV CEAKVEGQYR CEGTECGDGD NRYGGVCDKD GCDFNSYRMG NETFYGSNGS TIDTTKKFTV VTQFITADNT ATGALTEIRR KVVQNDVVIE NSYADYETLS KFNSITDFC AAQKTLSGDT NDFKTKGGIA RMGESFERGM VLVMSVWDDH AANALWLDSS YPTDADASKP GVKRGPCSTS SGVPSDVEAN DADSSVIYSN IRYGDIGSTF NKTA |
| SEQ ID NO: 105 | 50400675 | Trichoderma harzianum (anamorph of Hypocrea lixii) | MYRKLAVISA FLAAARAQQO CTQQAETHPP LTWQKCTASG CTPQQGSVVL DANWRWTHDT KSTTNCYDGN TWSSTLCPDD ATCAKNCCLD GANYSSTYGV TTSGDALTLQ FVTASNVGSR LYLMANDSTY QEFTLSGNEF SFDVDVSQLP CGLNGALYFV SMDADGGQSK YPGNAAGAKY GTGYCDSQCP RDLKFINGQA NVEGWEPSSN NANTGVGGHG SCCSEMDIWE ANSISEALTP HPCETVGQTM CSGDSCGGTY SNDRYGGTCD PDGCDWNPYR LGNTSFYGPG SSFALDTTKK LTVVTQFATD GSISRYYVQN GVKFQQPNAQ VGSYSGNTIN TDYCAAEQTA FGGTSFTDKG GLAQINKAFQ GGMVLVMSLW DDYAVNMLWL DSTYPTNATA STPGAKRGSC STSSGVPAQV EAQSPNSKVI YSNIRFGPIG STGGNTGSNP PGTSTTRAPP SSTGSSPTAT QTHYGQCGGT GWTGPTRCAS GYTCQVLNPF YSQCL |

TABLE 1-continued

| Sequence Identifier (SEQ ID NO:) | Database Accession Number | Species of Origin | Amino acid sequence |
|---|---|---|---|
| SEQ ID NO: 106 | 729649 | Neurospora crassa (OR74A) | MRASLLAFSL AAAVAGGQQA GTLTAKRHPS LTWQKCTRGG CPTLNTTMVL DANWRWTHAT SGSTKCYTGN KWQATLCPDG KSCAANCALD GADYTGYGI TGSGWSLTLQ FVTDNVGARA YLMADDTQYQ MLELLNQELW FDVDMSNIPC GLNGALYLSA MDADGMRKY PTNKAGAKYA TGYCDAQCPR DLKYINGIAN VEGWTPSTND ANGIGDHGSC CSEMDIWEAN KVSTAFTPHP CTTIEQHMCE GDSCGGTYSD DRYGVLCDAD GCDFNSYRMG NTTFYGEGKT VDTSSKFTVV TQFIKDSAGD LAEIKAFYVQ NGKVIENSQS NVDGVSGNSI TQSFCKSQKT AFGDIDDFNK KGGLKQMGKA LAQAMVLVMS IWDDHAANML WLDSTYPVPK VPGAYRGSGP TTSGVPAEVD ANAPNSKVAF SNIKFGHLGI SPFSGGSSGT PPSNPSSSAS PTSSTAKPSS TSTASNPSGT GAAHWAQCGG IGFSGPTTCP EPYTCAKDHD IYSQCV |
| SEQ ID NO: 107 | 119472134 | Neosartorya fischeri NRRL 181 | MLASTFSYRM YKTALILIAAL LGSGQAQOVG TSQAEVHPSM TWQSCTAGGS CTTNNGKVVI DANWRWVHKV GDYTNCYTGN TWDKTLCPDD ATCASNCALE GANYQSTYGA TTSGDSLRLN FVTTSQQKNI GSRLYMMKDD TTYEMFKLLN QEFTFDVDVS NLPCGLNGAL YFVAMDADGG MSKYPTNKAG AKYGTGYCDS QCPRDLKFIN GQANVEGWQP SSNDANAGTG NHGSCCAEMD IWEANSISTA FTPHPCDTPG QVMCTGDACG GTYSDRYGG TCDPDGCDFN SFRQGNKTFY GPGMTVDTKS KFTVVTQFIT DDGTASGTLK EIKRFYVQNG KVIPNSESTW SGVGGNSITN DYCTAQKSLF KDQNVFAKHG GMEGMGAALA QGMVLVMSLW DDHAANMLWL DSNYPTTASS STPGVARGTC DISSGVPADV EANHPDASVV YSNIKVGPIG STFNSGGSNP GGGTTTTAKP TTTTTTAGSP GGTGVAQHYG QCGGNGWQGP TTCASPYTCQ KLNDFYSQCL |
| SEQ ID NO: 108 | 117935080 | Chaetomium thermophilum | MQIKQYLQYL AAALPLVNMA AAQRAGTQQT ETHPRLSWKR CSSGGNCQTV NAEIVIDANW RWLHDSNYQN CYDGNRWTSA CSSATDCAQK CYLEGANYGS TYGVSTSGDA LTLKFVTKHE YGTNIGSRVY LMNGSDKYQM FTLMNNEFAF DVDLSKVECG LNSALYFVAM EEDGGMRSYS SNKAGAKYGT GYCDAQCARD LKFVGGKANI EGWRPSTNDA NAGVGPYGAC CAEIDVWESN AYAFAFTPHG CLNNNYHVCE TSNCGGTYSE DRFGGLCDAN GCDYNPYRMG NKDFYGKGKT VDTSRKFTVV TRFEENKLTQ FIQDGRKID IPPPTWPGLP NSSAITPELC TNLSKVFGDR DRYEETGGFR TINEALRIPM VLVMSIWDGH YASMLWLDSV YPPEKAQQPG AERGPCAPTS GVPAEVERAQF PNAQVIWSNI RFGPIGSTYQ V |
| SEQ ID NO: 109 | 154300584 | Botryotinia fuckeliana B05-10 | MTISRIALVSL FAAVYGQOVG TYQTETHPSL TWQSCTAKGS CTTNTGSIVL DGNWRWTHGV GTSTNCYTGN TWDATLCPDD ATCAQNCALE GADYSGTGI YFANLPADGG ISSTNTAGAE YGTGYCDSQC PRDMKFIKGQ THYKTFNLLN QEFTFDVDVS NLPCGLNGAV YFANLPADGG EANSISTAVT PHSCDTVTQT VCTGDDCGGT YSSSRYAGTC ANVDGWVPSS NMANTGVGNH GSCCAEMDIW TVVTQPLTTD GTASGTLNEI KRFVVQDGKV IPNSYSTISG DPDGCDFNSY RMGDETFYGP GKTVDINSVF ASMSAAFEAG MVLVLSLWDD YYANMLWLDS TYPVGKTSAG VSGNSITTPF CDAQKTAFGD PTSFSDHGGL GLGKAFDYGM VLVLSLWDDH QVNMLWLDSI YPTDQPASQP GPRGTCDTSS GVPASVEASS PNAYVVVSNI KVGAINSTYG |
| SEQ ID NO: 110 | 15824271 | Pseudotrichonympha grassii | MFVFVLLMLT QSLGTGTNQA ENHPSLSWQN CRSGGSCTQT SGSVVLDSNW RWTHDSSLLTN CYDGNEWSSS LCPDKPKTCSD NCLIDGADYS GTYGITSSGN SLKLVFVTNG PYSTNIGSRV YLLKDESHYQ IFDLKNKEFT FTVDDSNLDC GLNGALYFVS MDEDGGTSRF SSNKAGAKYG TGYCDAQCPH DIKFINGEAN VENWKPQTND ENAGNGRYGA CCTEMDIWEA NKYATAYTPH ICTVNGEYRC DGSECGDTDS GNRYGGVCDK DGCDFNSYRM GNTSFWGPGL IIDTGKPVTV VTQFVTVKDGT DNGQLSEIRR KVYQGGKVIE NTVVNIAGMS SGNSITDDFC NEQKSAFGDT NDFEKKGGLS GLGKAFDYGM VLVLSLWDDH QVNMLWLDSI YPTDQPASQP GVKRGPCATS SGAPSDVESQ HPDSSVTFSD IRFGPIDSTY |
| SEQ ID NO: 111 | 4586345 | Irpex lacteus | MFRKAALLAF SFLAIAHGQQ VGTNAQAENHP SLPSQKCTAS GCTTSSTSVV LDANWRWVHT TTGYTNCYTG QTWDASICPD GVTCAKACAL DGADYSGTYG ITTSSGNALTL QFVKGTNVGS RVYLLQDASN YQMFQLINQE FTFDVDMSNL PCGLNGAVYL SQMDQDGGVS RFPTNTAGAK YGTGYCDSQC PRDIKFINGE ANVEGWTGSS TDSNSGTGNY GTCCSEMDIW EANSVAAAYT PHPCSVNQGT TSGNLAEIRR PHPCSVNQGT RCTGADCGQG DDRYDGVCDP DGCDFNSFRM GQQTFLGKGL TVDTSRKFTI VTQFISDDGT QMGAALKSGM VLALSLWDDH AANMLWLDSD YPTTADASNP AVNSITDDFC TQQKTAFGDT NRFAAQGGLK AANMLWLDSD YPTTADASNP GVARGTCPTT |

TABLE 1-continued

| Sequence Identifier (SEQ ID NO:) | Database Accession Number | Species of Origin | Amino acid sequence |
|---|---|---|---|
| SEQ ID NO: 112 | 46241268 | Gibberella avenacea | SGFPRDVESQ SGSAATVTYSN IKWGDLNSTF TGTLTTPSGS SPSSPASTS GSSTSASSSA SVPTQSGTVA QWAQCGGIGY SGATTCVSPY TCHVNAYYS QCY<br>MYRAIATASA LIAAARAQQV CTLTTETKPA LTWSKCTSSG CTDVKGSVGI DANWRWTHQT SSSTNCYTGN KWDTSVCTSG ETCAQKCCLD GADYAGTYGI TSSGNQLSLG FVTKGSFSTN IGSRTYLMEN ENTYQMFQLL GNEFTFDVDV SNIGCGLNGA LYFVSMDADG GKARYPANKA GARYGTGYCD AQCPRDVKFI NGKANSDGWK PSDSDINAGI GNMGTCCPEM DIWEANSIST AFTPHPCTKL TQHACTGDSC GGTYSNDRYG GTCDADGCDF NSYRQGNKTF YGRGSDFNVD TTKKVTVVTQ FKKGSNGRLS EITRLYVQNG KVIANSESKI PGNSGGSLTA DFCSKQKSVF GDIDDFSKKG GWSGMSDALE SPPMVLVMSL WHDHHSNMLW LDSTYPTDST KLGAQRGSCA TTSGVPSDLE RDVPNSKVSF SNIKFGPIGS TYSSGTTNPP PSSTDTSTTP TNPPTGGTVG QYGQCGGQTY TGPKDCKSPY TCKKINDFYS QCQ |
| SEQ ID NO: 113 | 6164684 | Aspergillus niger | MSSFQIYRAA LLLSILATAN AQQVGTYTTE THPSLTWQTC TSDGSCTTND GEVVIDANWR WVHSTSSATN CYTGNEWDTS ICTDDVTCAA NCALDGATYE ATYGVTTSGS ELRLNFVTGG SSKNIGSRLY LMSDDSNYEL FKILGQEFTF DVDVSNLPCG LNGALYFVAM DADGTSEYS GNKAGAKYGT GYCDSQCPRD LKFINGEANC DGWEPSSNNV NTGVGDHGSC CAEMDWEAN SISNAFTAHP CDSVSQTMCD GDSCGGYTSA SGDRYSGTCD PDGCDYNPYR LGNTDFYGPG LTVDTNSPFT VVTQFITDDG TSSGTLTEIK RLYVQNGEVI ANGASTYSSV NGSSITSAFC ESEKTLFGDE NVFDKHGGLE GMGERAMAKGM VLVLSLWDDY AADMLWLDSD YPVNSSASTP GVARGTCSTD SGVPATVEAE SPNAVVTYSN IKFGPIGSTY SSGSGSGS SSSSSTTTK ATSTTLKTTS TTSSGSSSTS AAQAYGQCGG QGWTGPTTCV SGYTCTYENA YYSQCL |
| SEQ ID NO: 114 | 6164682 | Aspergillus niger | MHQRALLFSA LLTAVRAQQA GTLTEVHPS LTWQKCTSEG SCTEQSGSVV IDSNWRWTHS VNDSTNCYTG NTWDATLCPD DETCAANCAL DGADYESTYG VTTDGDSLTL KFVTGSNVGS RLYLMDTSDE GYQTFNLLDA EFTFDVDVSN LPCGLNGALY FTAMDADGGV SKYPANKAGA KYGTGYCDSQ CPRDLKFIDG QANVDGWEPS SNNDNTGIGN HGSCCPEMDI WEANKISTAL TPHPCDSSEQ TMCEGNDCGG TYSDRYGGT CDPDGCDFNP YRMGNDSFYG PGKTIDTGSK MTVVTQFITD GSGSLSEIKR YVVQNGNVIA NADSNISGVT GNSITTDFCT AQKKAFGDED IFAEHNGLAG ISDAMSSMVL ILSLWDDYYA SMEWLDSDYP ENATATDPGV ARGTCDSESG VPATVEGAHP DSSVTFSNIK FGPINSTFSA SA |
| SEQ ID NO: 115 | 33733371<br>U.S. Pat. No. 6,573,086-10 | Chrysosporium lucknowense | MYAKFATLAA LVAGAAAQNA CTLTAENHPS LTWSKCTSGG SCTTSVQGSIT IDANWRWTHR TDSATNCYEG NKWDTSYCSD GPSCASKCCI DGADYSSTYG ITTSGNSLNL KFVTKGQYST NIGSRTYLME SDTKYQMFQL LGNEFTFDVD VSNLGCGLNG ALYFVSMDAD GGMSKYSGNK AGAKYGTGYC DSQCPRDLKF INGEANVENW QSSTNDANAG TGKYGSCCSE MDVWEANNMA AAFTPHPCXV IGQSRCEGDS CGGTYSTDRY AGICDPDGCD FNSYRQGNKT FYGKGMTVDT TKKITVVTQF LKNSAGELSE IKRPYVQNGK VIPNSESTIP GVEGNSITQD WCDRQKAAFG DVTDXQDKGG MVQMGKALAG PMVLVMSIWD DHAVNMLWLD STWPIDGAGK PGAERGACPT TSGVPAEVEA EAPNSNVIFS NIRFGPIGST VSGLPDGGSG NPNPPVSSST PVPSSSTTSS GSSGPTGGTG VAKHYEQCGG IGFTGPTQCE SPYTCTKLND WYSQCL |
| SEQ ID NO: 116 | 29160311 | Thielavia australiensis | MYAKFATLAA LVAGASAQAV CSLTAETHPS LTWQKCTAPG SCTNVAGSIT IDANWRWTHQ TSSAATNCYSG SKWDSSICTT GTDCASKCCI DGAEYSSTYG ITTSGNALNL KFVTKGQYST NIGSRTYLME SDTKYQMFKL LGNEFTFDVD VSNLGCGLNG ALYFVSMDAD GGMSKYSGNK AGAKYGTGYC DAQCPRDLKF INGEANVEGW ESSTNDANAG SGKYGSCCTE MDVWEANNMA TAFTPHPCTT IGQTRCEGDT CGGTYSSDRY AGVCDPDGCD FNSYRQGNKT FYGKGMTVDT TKKITVVTQF LKNSAGELSE IKRFYAQDGK VIPNSESTIA GIPGNSITKA YCDAQKTVFQ NTDDFTAKGG LVQMGKALAG DHAVNMLWLD STYPTDQVGV AGAERGACPT TSGVPSDVEA NAPNSNVIFS NIRFGPIGST VQGLPSSGGT SSSSAAPQS TSTKASTTTS AVRTTSTATT KTTSSAPAQG TNTAKHWQQC GGNGWTGPTV CESPYKCTKQ NDWYSQCL |
| SEQ ID NO: 117 | 146197087 | uncultured symbiotic protist of | MLTIVYFLLS LVVSLEIGTQ QSEDHPKLTW QNGSSSVSGS IVLDSNWRMV HDSGTTNCYD GNLWSKDLCP SSDTCSQKCY IEGADYSGTY GIQSSGSKLT LKFVTKGSYS TNIGSRVLL KDENTYESFK LKNKEFTFTV |

TABLE 1-continued

| Sequence Identifier (SEQ ID NO:) | Database Accession Number | Species of Origin | Amino acid sequence |
|---|---|---|---|
| SEQ ID NO: 118 | | Reticulitermes speratus | DDSKLNCGLN GALYFVAMDA DGGKAKYGMGY KPGAKYGMGY CDAQCPHDMK FISGKANVDD WKPQDNDENS GNGKLGTCCS EMDIWEGNMK SQAYTVHACT KSGQYECTGQ QCGDTDSGDR FKGTCDKDGC DYASWRWGDQ SFYGEGKTVD TKQPVTVTQ FIGDPLTEIR RLYVQGGKTI NNSKTSNLAD TYDSITDKFC DATKEASGDT NDPKAKGAMS GFSTNLNNGQ VLVMSLWDDH TANMLWLDST YPTDSSDSTA QRGPCPTSSG VPKDVESQHG DATVVFSDIK FGAINSTFKY N |
| SEQ ID NO: 119 | 146197237 | uncultured symbiotic protist of Neotermes koshunensis | MLAAALFIFA CSVGVGTKTP ENHPKLNWQN CASKGSCSQV SGEVTMDSNW RWTHDGNGKN CYDGNTWISS LCPDDKTCSD KCVLDGAEYQ ATYGIQSNGT SYSTNIGSRL YLLKDKSTYY VFKLNNKEFT FSVDVSKLPC GLNGALYFVE MDADGGKAKY AGAKPGAEYG LGYCDAQCPS SGKSECGGQD DLKFINGEAN SEGWKPQSGD KNAGNGKYGS CCSEMDVWES NSQATALTPH VCKKTGQQRC SGKSECGGQD GQDRFAGLCD EDGCDFNNWR MGDKTFFGPG LIVDTKSPFV VVTQFVGSPV TEIRRKYVQN GKVIENSKSN IPGIDATAAI SDHFCBQQKK AFGDTNDFKN KGGFAKLGQV FDRGMVLVLS LWDDHQVAML WLDSTYPTNK DKSQPGVDRG PCPTSSGKPD DVESASADAT VVYGNIKFGA LDSTY |
| SEQ ID NO: 120 | 146197067 | uncultured symbiotic protist of Reticulitermes speratus | MLTIVYFILLS LVVSLEIGTQ QSEDHPKLTW QNGSSSVSGS IVLDSNWRWV HDSGTTNCYD GNLWSKDLCP SSNTCSQKCY IEGADYSGTY GIQSSGKLT LKFVTKGSYS TNIGSRVYLL KDENTYBSFK LKNKEFTFTV DDSKLNCGLN GALYFVAMDA DGGKAKYSSF KPGAKYGMGY CDAQCPHDMK FISGKANVDD WKPQDNDENS GNGKLGTCCS EMDIWEGNMK SQAYTVHACT KSGQYECTGQ QCGDTDSGDR FKGTCDKDGC DYASWRWGDQ SFYGEGKTVD TKQPVTVTQ FIGDPLTEIR RLYVQGGKTI NNSKTSNLAD TYDSITDKFC DATKEASGDT NDPKAKGAMS GFSTNLNNGQ VLVMSLWDDH TANMLWLDST YPTDSTKTGA SRGPCAVSSG VPKDVESQYG DATVIYSDIK FGAINSTFKW N |
| SEQ ID NO: 121 | 146197407 | uncultured symbiotic protist of Cryptocercus punctulatus | MIIALLSLAK SLGIATNQAE THPKLTWTRY QSKGSGQTVN GEIVLDSNWR WTHHSGTNCY DGNTWSTSLC PDPTTCSNNC DLDGADYPGT YGISTSGNSL KLGFVTHGSV STNIGSRVYL LRDSKNYEMF KLKNKEFTFT VDDSKLPCGL NGALYFVAMD EDGGVSKNSI NKAGAQYTG YCDAQCPHDM KFINGEANVL DWKPQSNDEN SGNGRYGACC TEMDIWEANS MATAYTPHVC TVTGLRRCEG TECGDTDANQ RYNGICDKDG CDFNSYRLGD KITFFGVGKTV DSSKPVTVVT QFVTSNGQDS GTLSEIRRKY VQGGKVIENS KVNIAGITAG NSVTDTFCNE QKKAFGDNND FEKKGGLGAL SKQLDAGMVL VLSLWDDHSV NMLWLDSTYP TNAAAGALGT ERGACATSSG APSDVESQSP DATVTFSDIK FGPIDSTY |
| SEQ ID NO: 121 | 146197157 | uncultured symbiotic protist of Hodotermopsis sjoestedti | MLVIALILRG LSVGTGTQQS ETHPSLSWQQ TSKGGSGQSV SGGVVLDSNW RWTHTTDGTT NCYDGNEWSS DLCPDASTCS SNCVLEGADY SGTYGITGSG SSLKLGFVTK GSYSTNIGSR VVILGDESHY KLFKLENNEF TFTVDDSNLE CGLNGALYFV AMDEDGGASK YSGAKPGAKY GMGYCDAQCP HDMKFINGDA NVEGWKPSDN DENAGTGKWG ACCTEMDIWE ANKYATAYTP VVTQFLADGG HICTKNGEYR CEGTDCGDTK DNNRYGGVCD KDGCDFNSWR MGNQSFWGPG LIIDTGKPVT VVTQFLADGG SLSEIRRKYV QGGKVIENTV TKISGMDEFD SITDEFCNQQ KKAFRDTNDF EKKGGLKGLG TAVDAGVVLV LSLWDDHDVN MLWLDSIYPT DSGSKAGADR GPCATSSGVP KDVESNYASA SVTFSDIKFG PIDSTY |
| SEQ ID NO: 122 | 146197403 | uncultured symbiotic protist of Cryptocercus punctulatus | MLLALAFPGK SLGIATNQAE NHPKLTWTRY QSKGSGQTVN GEIVLDSNWR WTHHSGTNCY DGNTWSTSLC PDPTTCSNNC DLDGADYPGT YGISSSGNSL KLGFVTHGSY STNIGSRVYL LRDSKNYEMF KLKNKEFTFT VDDSKLPCGL NGALYFVAMD EDGGVSKNSI NKAGAQYTGS YCDAQCPHDM KFINGEANVL DWKPQSNDEN SGNGRYGACC TEMDIWEANS MATAYTPHVC TVTGIRRCEG TECGDTDANQ RYNGICDKDG CDFNSYRLGD KSFFGVGKTV DSSKPVTVVT QFVTSNGQDS GTLSEIRRKY VQGGKVIENS KVNIAGMAAG NSITDTFCNE QKKAFGDNND FEKKGGLGAL SKQLDSGMVL VLSLWDDHSV NMLWLDSTYP TNAAAGALGT ERGACATSSG APSDVESQSP DATVTFSDIK FGPIDSTY |
| SEQ ID NO: 123 | 146197081 | uncultured symbiotic protist of Reticulitermes speratus | MLASVVLVS LVVSLEIGTQ QSEEHPKLTW QNGSSSVSGS IVLDSNWRWL HDSGTTNCYD GNLWSDDLCP NADTCSSKCY NADTCSSKCY GITSSGSKVT LKFVTKGSYS TNIGSRIYLL KDENTYETFK LKNKEFTFTV DDSKLDCGLN GALYFVAMDA DGGKAKYSSF KPGAKYGMGY CDAQCPHDMK FISGKANVDD WKPQDNDENS GDGKLGTCCS EMDIWEGNAK SQAYTVHACS KSGQYECTGQ QCGDTDSGDR FKGTCDKDGC DYASWRWGDQ |

TABLE 1-continued

| Sequence Identifier (SEQ ID NO:) | Database Accession Number | Species of Origin | Amino acid sequence |
|---|---|---|---|
| SEQ ID NO: 124 | 146197413 | uncultured symbiotic protist of Cryptocercus punctulatus | SFYGEGKTVD TKSPVTVVTQ FIGDPLTEIR RVYVQGGKTI NNSKTSNLAD TYDSITDKFC DATKDATGDT NDFKAKGAMA GFSTNLNTAQ VLVSVHCGMI IQPICCGLIR RIQRIQQKQV QAVDRVLCRR VFQRMLKASM VMLQSRTRTL SLELSTRPLV GISPAGRLFF F |
| SEQ ID NO: 125 | 146197309 | uncultured symbiotic protist of Mastotermes darwiniensis | MILALLVLGK SLGIATNQAE THPKLTWTRY QSKGSGSTVN GEIVLDSNWR WTHHSGTNCY DGNTWSTSLC PDPTTCSNNC DLDGADYPGT YGISTSGNSL KLGFVTHGSY STNIGSRVYL LKDTKSYEMF KLKNKEFTFT VDDSKLPCGL NGALYFVAMD EDGGVSKNSI NKAGAQYGTG YCDAQCPHDM KFINGEANVL DWKPQSNDEN SGNGRYGACC TEMDIWEANS MATAYTPHVC TVTGLRRCEG TECGDTNDQ RYNGICDKDG CDFNSYRLGD KSFFGVGKTV DSSKPVTVVT QFVTSNGQDS GTLSEIRRKY VQGGKVIENS KVNVAGITAG NSVTDTFCNE QKKAFGDNND FEKKGGLGAL SKQLDAGMVL VLSLWDDHSV NMLWLDSTYP TNAAAGALGT ERGACATSSG KPSDVESQSP DATVTFSDIK FGPIDSTY |
| SEQ ID NO: 126 | 146197227 | uncultured symbiotic protist of Neotermes koshunensis | MLCIGLISFV YSLGVGTNTA ETHPKLTWKN GGQTVNGEVT VDSNWRWTHT KGSTKNCYDG NLWSKDLCPD AATCGKNCVL EGADYSGTYG VTSSGNALTL KFVTHGSYST NVGSRLYLLK DEKTYQMFNL NGKEFTFTVD VSNLPCGLNG ALYHVNMDED GGTKRYPDNE AGAKYGTGYC DAQCPTDLKF INGIPNSDGW KPQSNDKNSG NGKYGSCCSE MDIWEANSIC SAVTPHVCDN LQQTRCQGTA CGENGGGSRF GSSCDPDGCN FNSWRMGNKT FYGPGLIVDT KSKFTVTQF VGNPVTEIKR KYVQNGKVIE NSYSNIEGMD KFNSVSDKFC TAQKKAFGDT DSFTKHGGFK QLGSALAKGM VLVLSLWDDH TVNMLWLDSV YPTNSKKAGS DRGPCPTTSG VPADVESKSA DANVIYSDIR FGAIDSTYK |
| SEQ ID NO: 127 | 146197253 | uncultured symbiotic protist of Neotermes koshunensis | MLGALVALAS CIGVGTNTPE KHPDLKWTNG GSSVSGSIVV DSNWRWTHIK GETKNCYDGN LWSDKYCPDA ATCGKNCVLE GADYSGTYGV TTSGDAATLK FVTHGQYSTN VGSRLYLLKD EKTYQMFNLV GKEFTFTVDV SNLPCGLNGA LYFVQMDSDG GMAKYPDNQA GAKYGTGYCD AQCPTDLKFI NGIPNSDGWK PQKNDKNSGN GKYGSCCSEM DIWEANSMAT AYTPHVCDKL EQTRCSGSAC GQNGGGDRFS SSCDPDGCDF NSWRMGNKTF WGPGLIVDTK KPVQVVTQFV GSSGSVTEIK RKYVQGGKVI DNSMTNIAAM SKQYNSVSDE FCQAQKKAFG DNDSFTKHGG FRQLGATLSK GHVLVLSLWD DHDVNMLWLD SVYPTNSNKP GADRGPCKTS SGVPSDVESQ NADSTVKYSD IRFGAIDSTY SK |
| SEQ ID NO: 128 | 146197099 | uncultured symbiotic protist of Reticulitermes speratus | MLAAALFTFA CSVGVGTKTT ETHPKLNWQQ CACKGSCSQV SGEVTMDSNW RWTHDGNGKN CYDGNTWISS LCPDDKTCSD KCVLDGAEYQ ATYGIQSNGT ALTPKFVTHG SYSTNIGSRL YLLKDKSTYY VFQLNNKEFT FSVDVSKLPC GLNGALYFVE MDADGGKSKY AGAKPGAEYG LGYCDAQCPS DLKFINGEAN SEGWKPQSGD KNAGNGKYGS CCSEMDVWES NSMATALTPH VCKTTGQTRC SGKSECGGQD GQDRFAGNCD EDGCDFNNWR MGDKTFFGPG LTVDTKSPFV VVTQFYGSPV TEIRRKYVQN GKVIENAKSN IPGIDATNAI SDTFCBQQKK AFGDTNDFKN KGGFTKLGSV FSRGMVLVLS LWDDHQVAML WLDSTYPTNK DKSVPGVDRG PCPTSSGKPD DVESASGDAT VVYGNIKFGA LDSTY |
| SEQ ID NO: 129 | 146197409 | uncultured symbiotic protist of Cryptocercus punctulatus | MFGFLLSLFA LQFALEIGTQ TSESHPSITW ELNGARQSGQ IVIDSNRWML HDSGTTNCYD GNTWSSDLCP DPEKCSQNCY LEBGADYSGTY GISASGSQLT LGFVTKGSYS TNIGSRVILL KDENTYPMFK LKNKEFTFTV DVSNLPCGLN GALYFVAMPS DGGKAKYPLA KPGAKYGMGY CDAQCPHDMK FINGEANVLD WKPQSNDENA GTGRYGTCCT EMDIWEANSQ ATAYTVHACS KNARCEGTEC GDDSASQRVN GICDKDGCDF NSWRMGNKTF FGPGLTVDSS KPVTVTQFI GDPLTEIRRI WVQGGKVIQN SFTNVSGLTS VDSITNTFCD ESKVATGDTN DFKAKGGMSG FSKALDTEVV LVLSLWDDHT ANMLWLDSTY PTDSTAIGAS RGPCATSSGD PKDVESASAN ASVKFSDIKF GALDSTY |
| SEQ ID NO: 130 | | uncultured symbiotic protist of Cryptocercus punctulatus | MLASLLPLSN SLGTASNQAE THPKLTWTQY TGKGAGQTVN GEIVLDSNWR WTHKDGTNCY DGNTWSSSLC PDPTTCSNNC NLDGADYPGT YGITTSGNQL KLGFVTHGSY STNIGSRVYL LRDSKNYQMF KLKNKEFTFT VDDSKLPCGL NGAVYFVAMD EDGGTAKHSI RATAYTPHIC NKAGAQYGTG YCDAQCPHDM KFINGEANVL DWKPQSNDEN SGNGRWGARC TEMDIWEANS TKTGLYRCEG TECGDSDTNR YGGVCDKDGC DFNSYRMGDK SFFGQGKTVD SSKPVTVVTQ FITDNNQDSG KLTEIRRKYV QGGKVIDNSK VNIAGITAGN PITDTFCDEA |

TABLE 1-continued

| Sequence Identifier (SEQ ID NO:) | Database Accession Number | Species of Origin | Amino acid sequence |
|---|---|---|---|
| SEQ ID NO: 130 | 146197315 | uncultured symbiotic protist of Mastotermes darwiniensis | KKAFGDNNDF EKKGGLSALG TQLEAGFVLV LSLMDDHSVN MLWLDSTYPT NASPGALGVE RGDCAITSGV PADVESQSAD ASVTFSDIKF GPIDSTY |
| SEQ ID NO: 131 | 146197411 | uncultured symbiotic protist of Cryptocercus punctulatus | MLCIGLISFV YSLGVGTNTA ETHPKLTWKN GGQTVNGEVT VDSNWRWTHT KGSTKNCYDG NLWSKDLCPD AATCGKNCVL EGADYSGTYG VTSSGNALTL KFVTHGSYST NVGSRLYLLK DEKTYQMFNL NGKEFTFTVD VSNLPCGLSG ALYHVNMDED GGTKRYPDNE AGAKYGTGYC DAQCPTDLKF INGIPNSDGW KPQSNDKNSG NGKYGSCCSE MDIWEANSIC SAVTPHVCDN LQQTRCQGAA CGENGGGSRF GSSCDPDGCD FNSWGMGNKT FYGPGLIVDT KSKFTVVTQF VGNPVTEIKR KYVQNGKVIE NSYSNIEGMD KFNSVSDKFC TAQKKAFGDT DSFTKHGGFK QLGSALAKGM VLVLSLWDDH TVNMLWLDSV YPTINSKKAGS DRGPCPTTSG VPADVESKSA DANVIYSDIR FGAIDSTYK |
| SEQ ID NO: 131 | 146197411 | uncultured symbiotic protist of Cryptocercus punctulatus | MIALLVLGK SLGIATNQAE THPKLTWTRY QSKSGSGSTVN GEIVLDSNWR WTHHSGTNCY DGNTWSTSLC PDPTTCSNNC DLDGADYPGT YGISTSGNSL KLGFVTHGSY STNIGSRVVL LRDSKNYEMF KLKNKEFTFT VDDSKLPCGL NGALYFVAMD EDGGVSKNSI NKAGAQYGTG YCDAQCPHDM KFINGEANVL DWKPQSNDEN SGNGRYGACC TEMDIWEANS MATAYTPHVC TVTGLRRCEG TECGDTDNDQ RYNGICDKDG CDFNSYRLGD KSFPFGVGTVK DSSKPVTVVT QFVTSNGQDS GILSETRRKY VQGGKVIENS KVNVAGITAG NSVTDTFCNE QKKAFGDNND FEKKGGLGAL SKQLDAGMVL VLSLWDDHSV NMLWLDSTYP TNAAAGALGT ERGACATSSG KPSDVESQSP DATVTFSDIK FGPIDSTYK |
| SEQ ID NO: 132 | 146197161 | uncultured symbiotic protist of Hodotermopsis sjoestedti | MIGIVLIQTV FGIGVGTQQS ESHPSLSWQQ CSKGGSCTSV SGSIVLDSNW RMTHIPDGTT NCYDGNEWSS DLCPDPTTCS NNCVLEGADY SGTYGISTSG SSAKLGFVTK GSYSTNIGSR VVLLGDESHY KIFDLKNKEF TFTVDDSNLE CGLNGALYFV AMDEDGGASR FTLAKPGAKY GTGYCDAQCP HDIKFINGEA NVQDWKPSDN DDNAGTHYG ACCTEMDIWE ANKYATAYTP HICTENGEYR CEGKSCGDSS DDRYGGVCDK DGCDFNSWRL GNQSFWGPGL IIDTGKPVTV QTQFVTKDGT DSGALSEIRR KYVQGGKTIE NTVVKISGID EVDSITDEFC NQQKQAFGDT NDFEKKGGLS GLGKAPDYGV VLVLSLWDDH DVNMLWLDSV YPTNPAGKAG ADRGPCATSS GDPKEVEDKY ASASVTFSDI KFGPIDSTY |
| SEQ ID NO: 133 | 146197323 | uncultured symbiotic protist of Mastotermes darwiniensis | MLVFGIVSFV YSIGVGTNTA ETHPKLTWKN GGSTTNGEVT VDSNWRWTHT KGSTKNCYDG NLWSKDLCPD AATCGKNCVL EGADYSGTYG VTSSGDALTL KFVTHGSYST NVGSRLYLLK DEKTYQMFNL NGKEFTFTVD VSQLPCGLNG ALYFVCMDQD GGMSRYPDNQ AGAKYGTGYC VGQTRCEGRA CGENGGDRF GSICDPDGCD FNSWRMGNKT NGKYGSCCSE MDIWEANSLA TAVTPHVCDQ IGSPVTEIKR EYVQGGKVIE NSYTNIEGMD KPNSISDKFC TAQKKAFGDN FWGPGLIIDT KKPVTVVTQF KLGQSFTKGQ VLVLSLWDDH TVNMLWLDSV YPTINSKKLGS DRGPCPTSSG VPADVESKNA DSFTKHGGFS FGSIDSTYK DSSVKYSDIR |
| SEQ ID NO: 134 | 146197077 | uncultured symbiotic protist of Reticulitermes speratus | MLSFVFLLGF GVSLEIGTQQ SENHPTLSWQ QCTSSGSCTS QSGSIVLDSN WRWVHDSGTT NCYDGNEWSS DLCPDPETCS KNCYLDGADY GITTSGKLT SSLKLGFVTE GSYSTNIGSR VVLKKDTNTY QIFKLKNHEF TFTVDVSNLP CGLNGALYFV EMEADGGKGK YPLAKPGAQY HICTKDGQYQ CEGTECGDSD GMGYCDAQCP HDMKFINGNA ANQRYNGVCD KDGCDFNSYR DENSGNGRYG TCCTEMDIWE ANSQATAYTP VVTQFITSNG QDSGDLTEIR RIVVQGGKTI QNSFTNIAGL TSVDSITEAF LGNKTFGPG LIVDSKKPVT TAMGKSLDTG VVLVLSLWDD HSVNMLWLDS TYPTDAAAGA LGTQRGPCAT CDESKDLFGD TNDFKAKGGF SSGAPSDVES QSPDASVTFS DIKFGPLDST Y |
| SEQ ID NO: 135 | 146197089 | uncultured symbiotic protist of Reticulitermes speratus | MLTIVVYLLS LVVSLEIGTQ QSESHPALTW QREGSSASGS IVLDSNWRMV HDSGTTNCYD GNEWSTDLCP SSDTCTKCY IEGADYSGTY GITTSSSKLT LKFVTKGSYS TNIGSRVLL KDENTYETFK LKNKEFTFTV DDSKLDCGLN GALYFVAMDA DGGKQKYSSF KPGAKYGMGY CDAQCPHDMK FISGKANVED WKPQDNDENS GNGKLGTCCS EMDIWEGNAK SQAYTVHACT KSGQYECTGT DCGDSDSRYQ GTCDKDGCDY ASYRWGDHSF YGEGKTVDTK QPITVVTQFI GDPLTEIRRL YIQGGKVINN SKTQNLASVY DSITDAFCDA TKAASGDTND FKAKGAMAGF SKNLDTPQVL VLSLWDDHTA NMLWLDSTYP TDSRDATAER GPCATSSGVP KDVESNQADA SVVFSDIKFG AINSTYSYN |

TABLE 1-continued

| Sequence Identifier (SEQ ID NO:) | Database Accession Number | Species of Origin | Amino acid sequence |
|---|---|---|---|
| SEQ ID NO: 136 | 146197091 | uncultured symbiotic protist of Reticulitermes speratus | MFGFLLSLFA LQFALEIGTQ TSESHPSITW ELNGARQSGQ IVIDSNWRML HDSGTTNCYD GNTWSSDLCP DPEKCSQNCY LEGADYSGTY GISASGSQLT LGFVTKGSYS TNIGSRVLLL KDENTYQMFK LKNKEFTFTV DVSNLPCGLN GALYFVAMPS DGGKAKYPLA KPGAKYGMGY CDAQCPHDMK FINGEANVLD WKPQSNDENA GTGRYGTCCT EMDIWEANSQ ATAYTVHACS KNARCEGTEC GDDSASQRYN GICDKDGCDF NSWRMGNKTF FGPGLTVDSS KPVTVVTQFI GDPLTEIRRI WVQGGKVIQN SFTNVSGITS VDSITNTFCD ESKVATGDTN DFKAKGMSG FSKALDTEVV LVLSLWDDHT ANMLWLDSTY PSNSTAIGAT RGPCATSSGD PKNVESASAN ASVKFSDIKF GAFDSTY |
| SEQ ID NO: 137 | 146197097 | uncultured symbiotic protist of Reticulitermes speratus | MLALVYFLLS LVVSLEIGTQ QSEDHPKLTW QNGSSSVSGS IVLDSNWRMV HDSGTTNCYD GNLWSTDLCP SSDTCTSKCY IEGADYSGTY GITSSGSKVT LKFVTKGSYS TNIGSRIYLL KDENTYETFK LKNKEFTFTV DDSQLNCGLN GALYFVAMDA DGGKAKYSSF KPGAKYGMGY CDAQCPHDMK FISGKANVDD WKPQDNDENS GNGKLGTCCS EMDIWEGNAK SQAYTVHACT KSGQYECTGQ QCGDTDSGDR FKGTCDKDGC DYASWRWGDQ SFYGEGKTVD TKQPVTVTQ FIGDPLTEIR RLYVQGGKTI NNSKTSNLAD TYDSITDKFC DATKRASGDT NDFKAKGAMS GFSTNLNTAQ VLVLSLWDDH TANMLWLDST YPTDSTKTGA SRGPCAVTSG VPKDVESQYG SAQVVYSDIK FGAINSTY |
| SEQ ID NO: 138 | 146197095 | uncultured symbiotic protist of Reticulitermes speratus | MLALVYFLLS FVVSLEIGTQ QSEDHPKLTW QNGSSSVSGS IVLDSNWRMV HDSGTTNCYD GNLWSTDLCG SSDTCSSKCY IEGADYSGTY GISASGSKLT LKFVTKGSYS TNIGSRVLLL KDENTYETFK LKGKEFTFTV DDSKLDCGLN GALYFVAMDA DGGKAKYGMGY CDAQCPHDMK FISGKANVDD WKPQDNDENS GNGKLGTCCS EMDIWEGNAK SQAYTVHACT KSGQYECTGQ QCGDTDSGDR FKGTCDKDGC DYASWRWGDQ SFYGEGKTID TKQPVTVTQ RVYVQGGKVI NNSKTSNLAN VVDSITDKFC DDTKDATGDT NDFKAKGAMS GFSTNLNTAQ VLVMSLWDDH TANMLWLDST YPTDSTKTGA SRGPCAVLSG VPKNVESQHG DATVIYSDIK FGAINSTFSY N |
| SEQ ID NO: 139 | 146197401 | uncultured symbiotic protist of Cryptocercus punctulatus | MFLALFVLGK SLGIATNQAE NHPKLTWTRY QSKGSGQTVN GEVVLDSNWR WTHHSGTNCY DGNTWSTSLC PDPQTCSSNC DLDGADYPGT YGISSSGNSL KLGFVTHGSY STNIGSRVYL LRDSKNYEMF KLKNKEFTFT VDDSKLPCGL NGALYFVAME EDGGVAKNSI NKAGAQYGTG YCDAQCPHDM KFINGEANVL DWKPQSNDEN SGNGRYGACC IEMDIWEANS MATAYTPHVC TVTGIHRCEG TECGDTDANQ RYNGICDKDG CDFNSYRMGD KSFFGVGKTV DSSKPVTVT QFVTSNGQDG GTLSEIKRKY VQGGKVIENS KVNIAGITAV TDAAAGALGT ERGACATSSG QKKAFGDNND FEKKGGLGAL SKQLDLGMVL VLSLWDDHSV NMLWLDSTYP KPSDVESQSP DASVTFSDIK FGPIDSTY |
| SEQ ID NO: 140 | 146197225 | uncultured symbiotic protist of Neotermes koshunensis | MLLCLLSIAN SLGVGTNTAE NHPKLSWKNG GSSVSGSVTV DANWRWTHIK GETKNCYDGN LWSDKYCPDA ATCGKNCVIE GADYQGTYGV VTSSGDGLTLT FVTHGQYSTN VGSRLYLMKD EKTYQMFNLN GKEFTFTVDV SNLPCGLNGA LYFVQMDSDG GMAKYPDNQA GAKYGTGYCD AQCPTDLKFI NGIPNSDGWK PQKNDKNSGN GKYGSCCSEM DIWEANSQAT AYTPHVCDTL EQTRCSGSSC GHTGGGERPS SSCDPDGCDF NSWRMGNKTF WGPGLIVDTK KPVQVVTQFV GSGNSCTEIK RKYVQGGKVI DNSMSNIAGM SKQYNSVSDD FCQAQKKAFG DNDSFTKHGG FRQLGATLGK GHVLVLSLWD DHDVNMLWLD SVYPTNSNKP GSDRGPCKTS SGIPADVESQ AASSSVKYSD IRFGAIDSTY K |
| SEQ ID NO: 141 | 146197317 | uncultured symbiotic protist of Mastotermes darwiniensis | MLCIGLISFV YSLGVGTNTA ETHPKLTWKN EGADYSGTYG VTSSGNALTL KFVTHGSYST NVGSRLYLMK DEKTYQMFNL NGKEFTFTVD VSNLPCGLNG ALYHVNMDED GGTKRYPDNE AGAKYGTGYC DAQCPTDLKF INGIPNSDGW KPQSNDKNSG NGKYGSCCSE MDIWEANSIC SAVTPHVCDT LQQTRCQGTA CGENGGGSRF GSSCDPDGCD FNSWRMGNKT FYGPLIVDT KSKFTVTQF VGSPVTEIKR KYVQNGKVIE NSFSNIEGMD KFNSISDKFC TAQKKAFGDT DSFTKHGGFK QLGSALAKGM VLVLSLWDDH TVNMLWLDSV YPTINSKKAGS DRGPCPTTSG VPADVESKSA NANVIYSDIR FGAIDSTYK |

TABLE 1-continued

| Sequence Identifier (SEQ ID NO:) | Database Accession Number | Species of Origin | Amino acid sequence |
|---|---|---|---|
| SEQ ID NO: 142 | 146197251 | uncultured symbiotic protist of Neotermes koshunensis | MLLCLLGIAS SLDAGTNTAE NHPQLSWKNG GSSVSGSVTV DANWRWTHIK GETKNCYDGN LWSDKYCPDA ATCGQNCVIE GADYQGTYGV SASGNALTLT FVTHGQYSTN VGSRLYLLKD EKTYQIFNLI GKEFTFTVDV SNLPCGLNGA LYFVQMDADG GTAKYSDNKA AQCPTDLKFI NGIPNSDGWK KPQNDKNSGN GRYGSCCSEM DWEANSLAT AYTPHVCDKL EQVRCDGRAC GQNGGGDRFS SSCDPDGCDF NSWRLGNKTF WGPGLIVDTK QPVQVVTQWV GGSTSVTEIK RKYVQGGKVI DNSFTKLDSL TKQYNSVSDE FCVAQKKAFG DNDSFTKHGG FRQLGATLAK GHVLVLSLWD DHDVNMLWLD SVYPTNSNKP GADRGPCKTS SGVPADVESQ AASSVKYSD IRFGAIDSTY K |
| SEQ ID NO: 143 | 146197319 | uncultured symbiotic protist of Mastotermes darwiniensis | MLGIGFVCIV YSLGVGTNTA ENHPKLTWKN SGSTTNGEVT VDSNWRWTHT KGTTKNCYDG NLWSKDLCPD AATCGKNCVL EGADYSGTYG VTSSGDALTL KFVTHGSYST NVGSRLYLLK DEKTYQIFNL NGKEFTFTVD VSNLPCGLNG ALYFVNMDAD GGTGRYPDNQ AGAKYGTYC DAQCPTDLKF INGIPNSDGW KPQSNDKNSG NGKYGSCCSE MDIWEANSLA TAVTPHVCDQ VGQTRCEGRA CGENGGGDRF GSSCDPDGCD FNSWRLGNKT FWGPGLIVDT KKPVTVTQF VGSPVTEIKR KYVQGGKVIE NSYTNIEGLD KFNSISDKFC TAQKKAFGDN DSFIKHGGFR QLGQSFTKGQ VLVLSLWDDH TVNMLWLDSV YPTNSKKPGA DRGPCPTSSG VPADVESKNA GSSVKYSDIR FGSIDSTYK |
| SEQ ID NO: 144 | 146197071 | uncultured symbiotic protist of Reticulitermes speratus | MATLVGILVS LFALEVALEI GTQTSESHPS LSWELNGQRQ TGSIVIDSNW RMLHDSGTTN CYDGNEWSSD LCPDPERKCSQ NCYLEGADYS GTYGISSSGN SLQLGFVTKG SYSTNIGSRV YLLKDENTYA TFKLKNKEFT FTADVSNLPC GLNGALYFVA MPADGGKSKY PLAKPGAKYG MGYCDAQCPH DMKFINGEAN ILDWKPSSND ENAGAGRYGT CCTEMDIWEA NSQATAYTVH ACSKNARCEG TECGDDDGRY NGICDKDGCD FNSWRWGNKT FFGPNLIVDS SKPVTVTQF IGDPLTEIRR IYVQGGKVIQ NSFTNISGVA SVDSITDAFC NENKVATGDT NDFKAKGGMS GFSKALDTEV VLVLSLWDDH TANMLWLDST YPTDSSALGA SRGPCAITSG EPKDVESASA NASVKFSDIK FGAIDSTY |
| SEQ ID NO: 145 | 146197075 | uncultured symbiotic protist of Reticulitermes speratus | MLTLVYFLLS LVVSLEIGTQ QSESHPQLSW QNGSSSVSGS IVLDSNWRWV HDSGTTNCYD GNLWSTDLCP SSDTCTSKCY IEGADYSGTY GITSSGSKLT LKFVTKGSYS TNIGSRVYLL KDENTYETFK LKNKEFTFTV DDSKLDCGLN GALYFVAMDA DGGKAKYSSF KPGAKYGMGY CDAQCPHDMK FISGKANVDD WKPQDNDENS GNGKLGTCCS EMDIWEGNAK SQAYTVHACT KSGQYECTGQ QCGDTDSGDR FKGTCDKDGC DYASWRWGDQ SFYGEGKTVD TKQPLTVVTQ FVGDPLTEIR RVYVQGGKTI NNSKTSNLAD TYDSITDKFC DATKEASGDT NDFKAKGAMS GFSTNLNTAQ VLVMSLWDDH TANMLWLDST YPTDSTKTGA SRGPCAVSSG VPKDVESQHG DATVIYSDIK FGAINSTFKW N |
| SEQ ID NO: 146 | 146197159 | uncultured symbiotic protist of Hodotermopsis sjoestedti | MLSIVSIFLV GLGFSLGVGT CDKNCYIEGA DYSGTYGITS WQNCSAKGSC QSVSGSIVLD SNWRWLHDSG TTNCYDGNEW STDLCPDAST CDKNCYIEGA DYSGTYGITS SGAQLKLGFV FVEMAEDGGA KPGAQYGMGY CDAQCPHDMK FITGEANVKD HYQLFLKNH EFTFTVDDSQ LPCGLNGALY FVEMAEDGGA ATAYTPHICS KTGIYRCEGT ECGNDANQOR YNGVCDKDGC DFNSYRLGNK GNGHYGACCT EMDIWEANSQ ATAYTPHICS KTGIYRCEGT QGGKTIQNSD TNVQGITTTN KITQAFCDET TFWGPGLTVD SNKAMIVVTQ FTTSNNQDSG ELSEIRRIYV QGGKTIQNSD TNVQGITTTN KITQAFCDET KVTFGDTNDF KAKGGFSGLS KSLESGAVLV LSLWDDHSVN MLWLDSTYPT DSAGKPGADR GPCAITSGDP KDVESQSPNA SVTFSDIKFG PIDSTY |
| SEQ ID NO: 147 | 146197405 | uncultured symbiotic protist of Cryptocercus punctulatus | MILALLVLGK SLGIATNQAE THPKLTWTRY QSKGSGSTVN GEIVLDSNWR WTHHSGTNCY DGNTWSTSLC PDPTTCSNNC DLDGADYPGT YGISTSGNSL KLGFVTHGSY STNIGSRVYL LKDTKSYEMF KLKNKEFTFT VDDSKLPCGL NGALYFVAMD EDGGVSKNSI NKAGAQYGTG YCDAQCPHDM KFINGEANVL DWKPQSNDEN SGNGRYGACC TEMDIWEANS MATAYTPHVC TVTGLRRCEG RYNGICDKDG CDFNSYRLGD KSFPFGVGKTV DSSKPVTVVT QFVTSNGQDS GTLSEIRRKY VQGGKVIENS KVNVAGITAG NSVTDTFCNE QKKAFGDNND FEKKGGFGAL SKQLVAGMVL VLSLWDDHSV NMLWLDSTYP TNAAAGALGT ERGACATSSG KPSDVESQSP DATVTFSDIK FGPIDSTY |

TABLE 1-continued

| Sequence Identifier (SEQ ID NO:) | Database Accession Number | Species of Origin | Amino acid sequence |
|---|---|---|---|
| SEQ ID NO: 148 | 146197327 | uncultured symbiotic protist of *Mastotermes darwiniensis* | MLCVGLFGLV YSIGVGTNTQ ETHPKLSWKQ CSSGGSCTTQ QGSVVIDSNW RWTHSTKDLT NCYDGNLWDS TLCPDGTTCS KNCVLEGADY SGTYGITSSG DSLTLKFVTH GSYSTNVGSR LYLLKDDNNY QIFNLAGKEF TFTVDVSNLP CGLNGALYFV EMDQDGGKGK HKENEAGAKY GTGYCDAQCP TDLKFIDGIA NSDGWKPQDN DENSGNGKYG SCCSEMDIWE ANSLATAYTP HVCDTKGQKR CQGTACGENG GGDRFGSECD PDGCDFNSWR QGNKSFWGPG LIIDTKKSVQ VVTQFIGSGS QNGKVIENSY STISGTEKYN SISDDYCNAQ KKAFGDTNSF ENHGGFKRFS QHIQDMVLVL SLWDDHTVNM LWLDSVYPTN SNKPGADRGP CETSSGVPAD VESKSASASV KYSDIRFGPI DSTYK |
| SEQ ID NO: 149 | 146197261 | uncultured symbiotic protist of *Neotermes koshunensis* | MLLCLWSIAY SLGVGTNTAE NHPKLSWKNG GSSVSGSVTV DANWRWTHIK GETKNCYDGN LWSDKYCPDA ATCGKNCVIE GADYQGTYGV SASGDGLTLT FVTHGQYSTN VGSRLYLMKD EKTYQIFNLN GKEFTFTVDV SNLPCGLNGA LYFVQMDSDG GMAKYPDNQA AQCPTDLKFI NGIPNSDGWK PQKNDKNSGN GKYGSCCSEM DIWEANSQAT AYTPHVCDKL EQTRCSGSAC GHTGGGERFS SSCDPDGCDF NSWRMGNKTF WGPGLIVDTK KPVQVVTQFV GSGNSCTEIK RKVVQGGKVI DNSMSNIAGM TKQYNSVSDD FCQAQKKAFG DNDSFTKHGG FRQLGATLGK GHVLVLSLWD DHDVNMLWLD SVYPTNSNKP GSDRGPCKTS SGIPADVESQ AASSSVKYSD IRFGAIDSTY K |

TABLE 2

| Sequence Identifier (SEQ ID NO:) | Database Accession Number | Species of Origin | Position corresponding to position 268 | Position corresponding to position 411 |
|---|---|---|---|---|
| SEQ ID NO: 1 | BD29555* | Unknown | 273 | 422 |
| SEQ ID NO: 2 | 340514556 | Trichoderma reesei | 268 | 411 |
| SEQ ID NO: 3 | 51243029 | Penicillium occitanis | 273 | 422 |
| SEQ ID NO: 4 | 7cel (PDB) & | Trichoderma reesei | 251 | 394 |
| SEQ ID NO: 5 | 67516425 | Aspergillus nidulans FGSC A4 | 274 | 424 |
| SEQ ID NO: 6 | 46107376 | Gibberella zeae PH-1 | 268 | 415 |
| SEQ ID NO: 7 | 70992391 | Aspergillus fumigatus Af293 | 277 | 427 |
| SEQ ID NO: 8 | 121699984 | Aspergillus clavatus NRRL 1 | 277 | 427 |
| SEQ ID NO: 9 | 1906845 | Claviceps purpurea | 269 | 416 |
| SEQ ID NO: 10 | 1gpi (PDB) & | Phanerochaete chrysosporium | 240 | 391 |
| SEQ ID NO: 11 | 119468034 | Neosartorya fischeri NRRL 181 | 265 | 414 |
| SEQ ID NO: 12 | 7804883 | Leptosphaeria maculans | 256 | 401 |
| SEQ ID NO: 13 | 85108032 | Neurospora crassa N150 | 268 | 412 |
| SEQ ID NO: 14 | 169859458 | Coprinopsis cinerea okayama | 270 | 421 |
| SEQ ID NO: 15 | 154292161 | Botryotinia fuckeliana B05-10 | — | 410 |
| SEQ ID NO: 16 | 169615761 # | Phaeosphaeria nodorum SN15 | 246 | 393 |
| SEQ ID NO: 17 | 4883502 | Humicola grisea | 272 | 413 |
| SEQ ID NO: 18 | 950686 | Humicola grisea | 270 | 416 |
| SEQ ID NO: 19 | 124491660 | Chaetomium thermophilum | 272 | 413 |
| SEQ ID NO: 20 | 58045187 | Chaetomium thermophilum | 270 | 416 |
| SEQ ID NO: 21 | 169601100 # | Phaeosphaeria nodorum SN15 | 237 | 383 |
| SEQ ID NO: 22 | 169870197 | Coprinopsis cinerea okayama | 269 | 421 |
| SEQ ID NO: 23 | 3913806 | Agaricus bisporus | 263 | 414 |
| SEQ ID NO: 24 | 169611094 | Phaeosphaeria nodorum SN15 | 270 | 414 |
| SEQ ID NO: 25 | 3131 | Phanerochaete chrysosporium | — | 410 |
| SEQ ID NO: 26 | 70991503 | Aspergillus fumigatus Af293 | 265 | 414 |
| SEQ ID NO: 27 | 294196 | Phanerochaete chrysosporium | 258 | 409 |
| SEQ ID NO: 28 | 18997123 | Thermoascus aurantiacus | 268 | 418 |
| SEQ ID NO: 29 | 4204214 | Humicola grisea var thermoidea | 272 | 413 |
| SEQ ID NO: 30 | 34582632 | Trichoderma viride (also known as Hypochrea rufa) | 268 | 411 |
| SEQ ID NO: 31 | 156712284 | Thermoascus aurantiacus | 268 | 418 |
| SEQ ID NO: 32 | 39977899 | Magnaporthe grisea (oryzae) 70-15 | 268 | 414 |
| SEQ ID NO: 33 | 20986705 | Talaromyces emersonii | 266 | 416 |
| SEQ ID NO: 34 | 22138843 | Aspergillus oryzae | 265 | 414 |
| SEQ ID NO: 35 | 55775695 | Penicillium chrysogenum | 276 | 426 |
| SEQ ID NO: 36 | 171676762 | Podospora anserina | 270 | 417 |
| SEQ ID NO: 37 | 146350520 | Pleurotus sp Florida | 268 | 420 |
| SEQ ID NO: 38 | 37732123 | Gibberella zeae | 268 | 415 |
| SEQ ID NO: 39 | 156055188 | Sclerotinia sclerotiorum 1980 | — | 410 |
| SEQ ID NO: 40 | 453224 | Phanerochaete chrysosporium | 258 | 409 |
| SEQ ID NO: 41 | 50402144 | Trichoderma reesei | 268 | 411 |
| SEQ ID NO: 42 | 115397177 | Aspergillus terreus NIH2624 | 274 | 424 |
| SEQ ID NO: 43 | 154312003 | Botryotinia fuckeliana B05-10 | 266 | 416 |
| SEQ ID NO: 44 | 49333365 | Volvariella volvacea | 268 | 420 |
| SEQ ID NO: 45 | 729650 | Penicillium janthinellum | 274 | 424 |
| SEQ ID NO: 46 | 146424871 | Pleurotus sp Florida | 267 | 418 |
| SEQ ID NO: 47 | 67538012 | Aspergillus nidulans FGSC A4 | 265 | 410 |
| SEQ ID NO: 48 | 62006162 | Fusarium poae | 268 | 415 |
| SEQ ID NO: 49 | 146424873 | Pleurotus sp Florida | 267 | 418 |
| SEQ ID NO: 50 | 295937 | Trichoderma viride | 268 | 411 |
| SEQ ID NO: 51 | 6179889 # | Alternaria alternata | 240 | 386 |
| SEQ ID NO: 52 | 119483864 | Neosartorya fischeri NRRL 181 | 278 | 428 |
| SEQ ID NO: 53 | 85083281 | Neurospora crassa OR74A | 270 | 412 |
| SEQ ID NO: 54 | 3913803 | Cryphonectria parasitica | 269 | 416 |
| SEQ ID NO: 55 | 60729633 | Corticium rolfsii | 265 | 415 |
| SEQ ID NO: 56 | 39971383 | Magnaporthe grisea 70-15 | 268 | 410 |
| SEQ ID NO: 57 | 39973029 | Magnaporthe grisea 70-15 | 269 | 410 |
| SEQ ID NO: 58 | 1170141 | Fusarium oxysporum | 268 | 415 |
| SEQ ID NO: 59 | 121710012 | Aspergillus clavatus NRRL 1 | 265 | 414 |
| SEQ ID NO: 60 | 17902580 | Penicillium funiculosum | 273 | 422 |
| SEQ ID NO: 61 | 1346226 | Humicola grisea var thermoidea | 270 | 416 |
| SEQ ID NO: 62 | 156712282 | Chaetomium thermophilum | 270 | 416 |
| SEQ ID NO: 63 | 169768818 | Aspergillus oryzae RIB40 | 277 | 427 |
| SEQ ID NO: 64 | 46241270 | Gibberella pulicaris | 268 | 415 |
| SEQ ID NO: 65 | 49333363 | Volvariella volvacea | 265 | 418 |
| SEQ ID NO: 66 | 46395332 | Irpex lacteus | 263 | 414 |
| SEQ ID NO: 67 | 50844407 # | Chaetomium thermophilum var thermophilum | 245 | 391 |
| SEQ ID NO: 68 | 4586347 | Irpex lacteus | 264 | 415 |
| SEQ ID NO: 69 | 3980202 | Phanerochaete chrysosporium | 258 | 410 |
| SEQ ID NO: 70 | 27125837 | Melanocarpus albomyces | 273 | 414 |
| SEQ ID NO: 71 | 171696102 | Podospora anserina | 265 | 415 |
| SEQ ID NO: 72 | 3913802 | Cochliobolus carbonum | 270 | 416 |
| SEQ ID NO: 73 | 50403723 | Trichoderma viride | 268 | 411 |

TABLE 2-continued

| Sequence Identifier (SEQ ID NO:) | Database Accession Number | Species of Origin | Position corresponding to position 268 | Position corresponding to position 411 |
|---|---|---|---|---|
| SEQ ID NO: 74 | 3913798 | *Aspergillus aculeatus* | 275 | 425 |
| SEQ ID NO: 75 | 66828465 | *Dictyostelium discoideum* | 269 | 419 |
| SEQ ID NO: 76 | 156060391 | *Sclerotinia sclerotiorum* 1980 | 252 | 402 |
| SEQ ID NO: 77 | 116181754 | *Chaetomium globosum* CBS 148-51 | 263 | 413 |
| SEQ ID NO: 78 | 145230535 | *Aspergillus niger* | 274 | 424 |
| SEQ ID NO: 79 | 46241266 | *Nectria haematococca* mpVI | 268 | 415 |
| SEQ ID NO: 80 | 1q9h (PDB) # | *Talaromyces emersonii* | 248 | 398 |
| SEQ ID NO: 81 | 157362170 | *Polyporus arcularius* | 269 | 420 |
| SEQ ID NO: 82 | 7804885 | *Leptosphaeria maculans* | 267 | 407 |
| SEQ ID NO: 83 | 121852 | *Phanerochaete chrysosporium* | 258 | 409 |
| SEQ ID NO: 84 | 126013214 | *Penicillium decumbens* | 264 | 415 |
| SEQ ID NO: 85 | 156048578 | *Sclerotinia sclerotiorum* 1980 | 265 | 413 |
| SEQ ID NO: 86 | 156712278 | *Acremonium thermophilum* | 269 | 414 |
| SEQ ID NO: 87 | 21449327 | *Aspergillus nidulans* | 265 | 410 |
| SEQ ID NO: 88 | 171683762 | *Podospora anserina* | 274 | 415 |
| SEQ ID NO: 89 | 56718412 | *Thermoascus aurantiacus* var *levisporus* | 268 | 418 |
| SEQ ID NO: 90 | 15824273 | *Pseudotrichonympha grassii* | 263 | 414 |
| SEQ ID NO: 91 | 115390801 | *Aspergillus terreus* NIH2624 | 266 | 411 |
| SEQ ID NO: 92 | 453223 | *Phanerochaete chrysosporium* | 258 | 409 |
| SEQ ID NO: 93 | 3132 | *Phanerochaete chrysosporium* | — | 407 |
| SEQ ID NO: 94 | 16304152 | *Thermoascus aurantiacus* | 268 | 417 |
| SEQ ID NO: 95 | 156712280 | *Acremonium thermophilum* | 273 | 420 |
| SEQ ID NO: 96 | 5231154 | *Volvariella volvacea* | 281 | 438 |
| SEQ ID NO: 97 | 116200349 | *Chaetomium globosum* CBS 148-51 | 270 | 412 |
| SEQ ID NO: 98 | 4586343 | *Irpex lacteus* | 263 | 414 |
| SEQ ID NO: 99 | 15321718 | *Lentinula edodes* | — | 417 |
| SEQ ID NO: 100 | 146424875 | *Pleurotus* sp *Florida* | 267 | 418 |
| SEQ ID NO: 101 | 62006158 | *Fusarium venenatum* | 268 | 415 |
| SEQ ID NO: 102 | 296027 | *Phanerochaete chrysosporium* | 258 | 409 |
| SEQ ID NO: 103 | 154449709 | *Fusicoccum* sp BCC4124 | 272 | 424 |
| SEQ ID NO: 104 | 169859460 | *Coprinopsis cinerea okayama* | 269 | 421 |
| SEQ ID NO: 105 | 50400675 | *Trichoderma harzianum* | 264 | 407 |
| SEQ ID NO: 106 | 729649 | *Neurospora crassa* | 262 | 406 |
| SEQ ID NO: 107 | 119472134 | *Neosartorya fischeri* NRRL 181 | 277 | 427 |
| SEQ ID NO: 108 | 117935080 | *Chaetomium thermophilum* | 272 | 413 |
| SEQ ID NO: 109 | 154300584 | *Botryotinia fuckeliana* B05-10 | 265 | 413 |
| SEQ ID NO: 110 | 15824271 | *Pseudotrichonympha grassii* | 263 | 414 |
| SEQ ID NO: 111 | 4586345 | *Irpex lacteus* | 263 | 414 |
| SEQ ID NO: 112 | 46241268 | *Gibberella avenacea* | 268 | 416 |
| SEQ ID NO: 113 | 6164684 | *Aspergillus niger* | 274 | 424 |
| SEQ ID NO: 114 | 6164682 | *Aspergillus niger* | 266 | 412 |
| SEQ ID NO: 115 | 33733371 | *Chrysosporium lucknowense* US6573086-10 | 269 | 415 |
| SEQ ID NO: 116 | 29160311 | *Thielavia australiensis* | 269 | 415 |
| SEQ ID NO: 117 | 146197087 | uncultured symbiotic protist of *Reticulitermes speratus* | 260 | 402 |
| SEQ ID NO: 118 | 146197237 | uncultured symbiotic protist of *Neotermes koshunensis* | 264 | 409 |
| SEQ ID NO: 119 | 146197067 | uncultured symbiotic protist of *Reticulitermes speratus* | 260 | 402 |
| SEQ ID NO: 120 | 146197407 | uncultured symbiotic protist of *Cryptocercus punctulatus* | 261 | 412 |
| SEQ ID NO: 121 | 146197157 | uncultured symbiotic protist of *Hodotermopsis sjoestedti* | 264 | 410 |
| SEQ ID NO: 122 | 146197403 | uncultured symbiotic protist of *Cryptocercus punctulatus* | 261 | 412 |
| SEQ ID NO: 123 | 146197081 | uncultured symbiotic protist of *Reticulitermes speratus* | 260 | 410 |
| SEQ ID NO: 124 | 146197413 | uncultured symbiotic protist of *Cryptocercus punctulatus* | 261 | 412 |
| SEQ ID NO: 125 | 146197309 | uncultured symbiotic protist of *Mastotermes darwiniensis* | 259 | 402 |
| SEQ ID NO: 126 | 146197227 | uncultured symbiotic protist of *Neotermes koshunensis* | 258 | 404 |
| SEQ ID NO: 127 | 146197253 | uncultured symbiotic protist of *Neotermes koshunensis* | 264 | 409 |
| SEQ ID NO: 128 | 146197099 | uncultured symbiotic protist of *Reticulitermes speratus* | 258 | 401 |
| SEQ ID NO: 129 | 146197409 | uncultured symbiotic protist of *Cryptocercus punctulatus* | 260 | 411 |
| SEQ ID NO: 130 | 146197315 | uncultured symbiotic protist of *Mastotermes darwiniensis* | 259 | 402 |

TABLE 2-continued

| Sequence Identifier (SEQ ID NO:) | Database Accession Number | Species of Origin | Position corresponding to position 268 | Position corresponding to position 411 |
|---|---|---|---|---|
| SEQ ID NO: 131 | 146197411 | uncultured symbiotic protist of Cryptocercus punctulatus | 261 | 412 |
| SEQ ID NO: 132 | 146197161 | uncultured symbiotic protist of Hodotermopsis sjoestedti | 263 | 413 |
| SEQ ID NO: 133 | 146197323 | uncultured symbiotic protist of Mastotermes darwiniensis | 259 | 402 |
| SEQ ID NO: 134 | 146197077 | uncultured symbiotic protist of Reticulitermes speratus | 264 | 415 |
| SEQ ID NO: 135 | 146197089 | uncultured symbiotic protist of Reticulitermes speratus | 258 | 400 |
| SEQ ID NO: 136 | 146197091 | uncultured symbiotic protist of Reticulitermes speratus | 258 | 401 |
| SEQ ID NO: 137 | 146197097 | uncultured symbiotic protist of Reticulitermes speratus | 260 | 402 |
| SEQ ID NO: 138 | 146197095 | uncultured symbiotic protist of Reticulitermes speratus | 260 | 402 |
| SEQ ID NO: 139 | 146197401 | uncultured symbiotic protist of Cryptocercus punctulatus | 261 | 412 |
| SEQ ID NO: 140 | 146197225 | uncultured symbiotic protist of Neotermes koshunensis | 258 | 404 |
| SEQ ID NO: 141 | 146197317 | uncultured symbiotic protist of Mastotermes darwiniensis | 259 | 402 |
| SEQ ID NO: 142 | 146197251 | uncultured symbiotic protist of Neotermes koshunensis | 258 | 404 |
| SEQ ID NO: 143 | 146197319 | uncultured symbiotic protist of Mastotermes darwiniensis | 259 | 402 |
| SEQ ID NO: 144 | 146197071 | uncultured symbiotic protist of Reticulitermes speratus | 259 | 402 |
| SEQ ID NO: 145 | 146197075 | uncultured symbiotic protist of Reticulitermes speratus | 260 | 402 |
| SEQ ID NO: 146 | 146197159 | uncultured symbiotic protist of Hodotermopsis sjoestedti | 260 | 410 |
| SEQ ID NO: 147 | 146197405 | uncultured symbiotic protist of Cryptocercus punctulatus | 261 | 412 |
| SEQ ID NO: 148 | 146197327 | uncultured symbiotic protist of Mastotermes darwiniensis | 264 | 408 |
| SEQ ID NO: 149 | 146197261 | uncultured symbiotic protist of Neotermes koshunensis | 258 | 404 |

TABLE 3

| SEQ ID NO: | Database Accession Number | Species of Origin | Signal sequence (SS) start and end position | Catalytic Domain (CD) start and end position | Linker start and end position | Cellulose Binding Domain (CBD) start and end |
|---|---|---|---|---|---|---|
| SEQ ID NO: 1 | BD29555* | Unknown | 1-25 | 26-455 | 456-493 | 494-529 |
| SEQ ID NO: 2 | 340514556 | Trichoderma reesei | 1-17 | 18-444 | 445-479 | 480-514 |
| SEQ ID NO: 3 | 51243029 | Penicillium occitanis | 1-25 | 26-455 | 456-493 | 494-529 |
| SEQ ID NO: 4 | 7cel (PDB) & | Trichoderma reesei | N/A | 1-427 | N/A | N/A |
| SEQ ID NO: 5 | 67516425 | Aspergillus nidulans FGSC A4 | 1-23 | 24-457 | 458-490 | 491-526 |
| SEQ ID NO: 6 | 46107376 | Gibberella zeae PH-1 | 1-17 | 18-448 | 449-476 | 477-512 |
| SEQ ID NO: 7 | 70992391 | Aspergillus fumigatus Af293 | 1-26 | 27-460 | 461-496 | 497-532 |
| SEQ ID NO: 8 | 121699984 | Aspergillus clavatus NRRL 1 | 1-27 | 27-460 | 461-503 | 504-539 |
| SEQ ID NO: 9 | 1906845 | Claviceps purpurea | 1-19 | 20-449 | N/A | N/A |
| SEQ ID NO: 10 | 1gpi (PDB) & | Phanerochaete chrysosporium | N/A | 1-424 | N/A | N/A |
| SEQ ID NO: 11 | 119468034 | Neosartorya fischeri NRRL 181 | 1-17 | 18-447 | N/A | N/A |
| SEQ ID NO: 12 | 7804883 | Leptosphaeria maculans | 1-17 | 18-434 | N/A | N/A |
| SEQ ID NO: 13 | 85108032 | Neurospora crassa N150 | 1-17 | 18-445 | 446-485 | 486-521 |
| SEQ ID NO: 14 | 169859458 | Coprinopsis cinerea okayama | 1-18 | 19-454 | N/A | N/A |
| SEQ ID NO: 15 | 154292161 | Botryotinia fuckeliana B05-10 | 1-18 | 19-443 | 444-555 | 556-596 |
| SEQ ID NO: 16 | 169615761 # | Phaeosphaeria nodorum SN15 | 1 | 2-426 | N/A | N/A |

TABLE 3-continued

| SEQ ID NO: | Database Accession Number | Species of Origin | Signal sequence (SS) start and end position | Catalytic Domain (CD) start and end position | Linker start and end position | Cellulose Binding Domain (CBD) start and end |
|---|---|---|---|---|---|---|
| SEQ ID NO: 17 | 4883502 | Humicola grisea | 1-22 | 23-446 | N/A | N/A |
| SEQ ID NO: 18 | 950686 | Humicola grisea | 1-18 | 19-449 | 450-489 | 490-525 |
| SEQ ID NO: 19 | 124491660 | Chaetomium thermophilum | 1-22 | 23-446 | N/A | N/A |
| SEQ ID NO: 20 | 58045187 | Chaetomium thermophilum | 1-18 | 19-449 | 450-494 | 495-530 |
| SEQ ID NO: 21 | 169601100 # | Phaeosphaeria nodorum SN15 | 1 | 2-416 | N/A | N/A |
| SEQ ID NO: 22 | 169870197 | Coprinopsis cinerea okayama | 1-18 | 19-454 | N/A | N/A |
| SEQ ID NO: 23 | 3913806 | Agaricus bisporus | 1-18 | 19-447 | 448-470 | 471-506 |
| SEQ ID NO: 24 | 169611094 | Phaeosphaeria nodorum SN15 | 1-18 | 19-447 | N/A | N/A |
| SEQ ID NO: 25 | 3131 | Phanerochaete chrysosporium | 1-19 | 20-443 | N/A | N/A |
| SEQ ID NO: 26 | 70991503 | Aspergillus fumigatus Af293 | 1-17 | 18-447 | N/A | N/A |
| SEQ ID NO: 27 | 294196 | Phanerochaete chrysosporium | 1-18 | 19-442 | 443-480 | 481-516 |
| SEQ ID NO: 28 | 18997123 | Thermoascus aurantiacus | 1-17 | 18-451 | N/A | N/A |
| SEQ ID NO: 29 | 4204214 | Humicola grisea var thermoidea | 1-22 | 23-446 | N/A | N/A |
| SEQ ID NO: 30 | 34582632 | Trichoderma viride (also known as Hypochrea rufa) | 1-18 | 18-444 | 445-479 | 480-514 |
| SEQ ID NO: 31 | 156712284 | Thermoascus aurantiacus | 1-17 | 18-451 | N/A | N/A |
| SEQ ID NO: 32 | 39977899 | Magnaporthe grisea (oryzae) 70-15 | 1-17 | 18-447 | N/A | N/A |
| SEQ ID NO: 33 | 20986705 | Talaromyces emersonii | 1-18 | 19-449 | N/A | N/A |
| SEQ ID NO: 34 | 22138843 | Aspergillus oryzae | 1-17 | 18-447 | N/A | N/A |
| SEQ ID NO: 35 | 55775695 | Penicillium chrysogenum | 1-25 | 26-459 | 460-494 | 495-529 |
| SEQ ID NO: 36 | 171676762 | Podospora anserina | 1-18 | 19-450 | 451-492 | 493-528 |
| SEQ ID NO: 37 | 146350520 | Pleurotus sp Florida | 1-18 | 19-453 | N/A | N/A |
| SEQ ID NO: 38 | 37732123 | Gibberella zeae | 1-17 | 18-448 | 449-476 | 477-512 |
| SEQ ID NO: 39 | 156055188 | Sclerotinia sclerotiorum 1980 | 1-18 | 19-443 | 444-546 | 547-586 |
| SEQ ID NO: 40 | 453224 | Phanerochaete chrysosporium | 1-18 | 19-442 | 443-474 | 475-510 |
| SEQ ID NO: 41 | 50402144 | Trichoderma reesei | 1-17 | 18-444 | 445-478 | 479-513 |
| SEQ ID NO: 42 | 115397177 | Aspergillus terreus NIH2624 | 1-23 | 24-457 | 458-505 | 506-541 |
| SEQ ID NO: 43 | 154312003 | Botryotinia fuckeliana B05-10 | 1-17 | 18-449 | 450-480 | 481-516 |
| SEQ ID NO: 44 | 49333365 | Volvariella volvacea | 1-18 | 19-453 | N/A | N/A |
| SEQ ID NO: 45 | 729650 | Penicillium janthinellum | 1-25 | 26-456 | 457-502 | 503-537 |
| SEQ ID NO: 46 | 146424871 | Pleurotus sp Florida | 1-18 | 19-451 | 452-487 | 488-523 |
| SEQ ID NO: 47 | 67538012 | Aspergillus nidulans FGSC A4 | 1-17 | 18-443 | N/A | N/A |
| SEQ ID NO: 48 | 62006162 | Fusarium poae | 1-17 | 18-448 | 449-475 | 476-511 |
| SEQ ID NO: 49 | 146424873 | Pleurotus sp Florida | 1-18 | 19-451 | 452-487 | 488-523 |
| SEQ ID NO: 50 | 295937 | Trichoderma viride | 1-17 | 18-444 | 445-478 | 479-513 |
| SEQ ID NO: 51 | 6179889 # | Alternaria alternata | 1 | 2-419 | N/A | N/A |
| SEQ ID NO: 52 | 119483864 | Neosartorya fischeri NRRL 181 | 1-26 | 27-461 | 462-499 | 500-535 |
| SEQ ID NO: 53 | 85083281 | Neurospora crassa OR74A | 1-20 | 21-445 | N/A | N/A |
| SEQ ID NO: 54 | 3913803 | Cryphonectria parasitica | 1-18 | 19-449 | N/A | N/A |
| SEQ ID NO: 55 | 60729633 | Corticium rolfsii | 1-18 | 19-448 | 449-492 | 493-528 |
| SEQ ID NO: 56 | 39971383 | Magnaporthe grisea 70-15 | 1-17 | 18-443 | N/A | N/A |
| SEQ ID NO: 57 | 39973029 | Magnaporthe grisea 70-15 | 1-19 | 20-443 | N/A | N/A |
| SEQ ID NO: 58 | 1170141 | Fusarium oxysporum | 1-17 | 18-448 | 449-478 | 479-514 |
| SEQ ID NO: 59 | 121710012 | Aspergillus clavatus NRRL 1 | 1-17 | 18-447 | N/A | N/A |
| SEQ ID NO: 60 | 17902580 | Penicillium funiculosum | 1-25 | 26-455 | 456-493 | 494-529 |

TABLE 3-continued

| SEQ ID NO: | Database Accession Number | Species of Origin | Signal sequence (SS) start and end position | Catalytic Domain (CD) start and end position | Linker start and end position | Cellulose Binding Domain (CBD) start and end |
|---|---|---|---|---|---|---|
| SEQ ID NO: 61 | 1346226 | Humicola grisea var thermoidea | 1-18 | 19-449 | 450-489 | 490-525 |
| SEQ ID NO: 62 | 156712282 | Chaetomium thermophilum | 1-18 | 19-449 | 450-496 | 497-532 |
| SEQ ID NO: 63 | 169768818 | Aspergillus oryzae RIB40 | 1-25 | 26-460 | N/A | N/A |
| SEQ ID NO: 64 | 46241270 | Gibberella pulicaris | 1-17 | 18-448 | 449-474 | 475-510 |
| SEQ ID NO: 65 | 49333363 | Volvariella volvacea | 1-18 | 19-451 | 452-476 | 477-512 |
| SEQ ID NO: 66 | 46395332 | Irpex lacteus | 1-18 | 19-447 | 448-485 | 486-521 |
| SEQ ID NO: 67 | 50844407 # | Chaetomium thermophilum var thermophilum | N/A | 1-424 | 425-469 | 470-505 |
| SEQ ID NO: 68 | 4586347 | Irpex lacteus | 1-18 | 19-448 | 449-490 | 491-526 |
| SEQ ID NO: 69 | 3980202 | Phanerochaete chrysosporium | 1-18 | 19-443 | 444-475 | 476-511 |
| SEQ ID NO: 70 | 27125837 | Melanocarpus albomyces | 1-23 | 23-447 | N/A | N/A |
| SEQ ID NO: 71 | 171696102 | Podospora anserina | 1-17 | 17-448 | N/A | N/A |
| SEQ ID NO: 72 | 3913802 | Cochliobolus carbonum | 1-18 | 19-449 | N/A | N/A |
| SEQ ID NO: 73 | 50403723 | Trichoderma viride | 1-17 | 18-444 | 445-479 | 480-514 |
| SEQ ID NO: 74 | 3913798 | Aspergillus aculeatus | 1-22 | 23-458 | 459-505 | 506-540 |
| SEQ ID NO: 75 | 66828465 | Dictyostelium discoideum | 1-19 | 20-452 | N/A | N/A |
| SEQ ID NO: 76 | 156060391 | Sclerotinia sclerotiorum 1980 | 1-17 | 18-435 | 436-470 | 471-504 |
| SEQ ID NO: 77 | 116181754 | Chaetomium globosum CBS 148-51 | 1-17 | 18-446 | N/A | N/A |
| SEQ ID NO: 78 | 145230535 | Aspergillus niger | 1-21 | 22-457 | 458-500 | 501-536 |
| SEQ ID NO: 79 | 46241266 | Nectria haematococca mpVI | 1-18 | 18-448 | 449-472 | 473-508 |
| SEQ ID NO: 80 | 1q9h (PDB) # | Talaromyces emersonii | N/A | 1-431 | N/A | N/A |
| SEQ ID NO: 81 | 157362170 | Polyporus arcularius | 1-18 | 19-453 | N/A | N/A |
| SEQ ID NO: 82 | 7804885 | Leptosphaeria maculans | 1-20 | 21-440 | N/A | N/A |
| SEQ ID NO: 83 | 121852 | Phanerochaete chrysosporium | 1-18 | 19-442 | 443-480 | 481-516 |
| SEQ ID NO: 84 | 126013214 | Penicillium decumbens | 1-17 | 18-448 | N/A | N/A |
| SEQ ID NO: 85 | 156048578 | Sclerotinia sclerotiorum 1980 | 1-16 | 17-446 | N/A | N/A |
| SEQ ID NO: 86 | 156712278 | Acremonium thermophilum | 1-17 | 18-447 | 448-487 | 488-523 |
| SEQ ID NO: 87 | 21449327 | Aspergillus nidulans | 1-17 | 18-443 | N/A | N/A |
| SEQ ID NO: 88 | 171683762 | Podospora anserina | 1-22 | 23-448 | N/A | N/A |
| SEQ ID NO: 89 | 56718412 | Thermoascus aurantiacus var levisporus | 1-17 | 18-451 | N/A | N/A |
| SEQ ID NO: 90 | 15824273 | Pseudotrichonympha grassii | 1-20 | 21-447 | N/A | N/A |
| SEQ ID NO: 91 | 115390801 | Aspergillus terreus NIH2624 | 1-17 | 18-444 | N/A | N/A |
| SEQ ID NO: 92 | 453223 | Phanerochaete chrysosporium | 1-18 | 19-442 | 443-474 | 475-510 |
| SEQ ID NO: 93 | 3132 | Phanerochaete chrysosporium | 1-19 | 20-436 | 437-467 | 468-504 |
| SEQ ID NO: 94 | 16304152 | Thermoascus aurantiacus | 1-17 | 18-450 | N/A | N/A |
| SEQ ID NO: 95 | 156712280 | Acremonium thermophilum | 1-21 | 22-453 | N/A | N/A |
| SEQ ID NO: 96 | 5231154 | Volvariella volvacea | 1-15 | 16-472 | 473-500 | 501-536 |
| SEQ ID NO: 97 | 116200349 | Chaetomium globosum CBS 148-51 | 1-20 | 21-445 | N/A | N/A |
| SEQ ID NO: 98 | 4586343 | Irpex lacteus | 1-18 | 19-447 | 448-481 | 482-517 |
| SEQ ID NO: 99 | 15321718 | Lentinula edodes | 1-18 | 19-450 | 451-480 | 481-516 |
| SEQ ID NO: 100 | 146424875 | Pleurotus sp Florida | 1-18 | 19-451 | 452-487 | 488-523 |
| SEQ ID NO: 101 | 62006158 | Fusarium venenatum | 1-17 | 18-448 | 449-471 | 472-507 |
| SEQ ID NO: 102 | 296027 | Phanerochaete chrysosporium | 1-18 | 19-442 | 443-480 | 481-516 |

TABLE 3-continued

| SEQ ID NO: | Database Accession Number | Species of Origin | Signal sequence (SS) start and end position | Catalytic Domain (CD) start and end position | Linker start and end position | Cellulose Binding Domain (CBD) start and end |
|---|---|---|---|---|---|---|
| SEQ ID NO: 103 | 154449709 | *Fusicoccum* sp BCC4124 | 1-19 | 20-457 | N/A | N/A |
| SEQ ID NO: 104 | 169859460 | *Coprinopsis cinerea okayama* | 1-18 | 19-454 | N/A | N/A |
| SEQ ID NO: 105 | 50400675 | *Trichoderma harzianum* | 1-17 | 18-440 | 441-470 | 471-505 |
| SEQ ID NO: 106 | 729649 | *Neurospora crassa* | 1-17 | 18-439 | 440-480 | 481-516 |
| SEQ ID NO: 107 | 119472134 | *Neosartorya fischeri* NRRL 181 | 1-26 | 27-460 | 461-494 | 495-530 |
| SEQ ID NO: 108 | 117935080 | *Chaetomium thermophilum* | 1-22 | 23-446 | N/A | N/A |
| SEQ ID NO: 109 | 154300584 | *Botryotinia fuckeliana* B05-10 | 1-16 | 17-446 | N/A | N/A |
| SEQ ID NO: 110 | 15824271 | *Pseudotrichonympha grassii* | 1-20 | 21-447 | N/A | N/A |
| SEQ ID NO: 111 | 4586345 | *Irpex lacteus* | 1-18 | 19-447 | 448-487 | 488-523 |
| SEQ ID NO: 112 | 46241268 | *Gibberella avenacea* | 1-17 | 18-449 | 450-478 | 478-513 |
| SEQ ID NO: 113 | 6164684 | *Aspergillus niger* | 1-21 | 22-457 | 458-500 | 501-536 |
| SEQ ID NO: 114 | 6164682 | *Aspergillus niger* | 1-17 | 18-445 | N/A | N/A |
| SEQ ID NO: 115 | 33733371 | *Chrysosporium lucknowense* US6573086-10 | 1-17 | 18-448 | 449-490 | 491-526 |
| SEQ ID NO: 116 | 29160311 | *Thielavia australiensis* | 1-18 | 18-448 | 449-502 | 503-538 |
| SEQ ID NO: 117 | 146197087 | uncultured symbiotic protist of *Reticulitermes speratus* | 1-22 | 23-435 | N/A | N/A |
| SEQ ID NO: 118 | 146197237 | uncultured symbiotic protist of *Neotermes koshunensis* | 1-20 | 21-442 | N/A | N/A |
| SEQ ID NO: 119 | 146197067 | uncultured symbiotic protist of *Reticulitermes speratus* | 1-22 | 23-435 | N/A | N/A |
| SEQ ID NO: 120 | 146197407 | uncultured symbiotic protist of *Cryptocercus punctulatus* | 1-19 | 20-445 | N/A | N/A |
| SEQ ID NO: 121 | 146197157 | uncultured symbiotic protist of *Hodotermopsis sjoestedti* | 1-20 | 21-443 | N/A | N/A |
| SEQ ID NO: 122 | 146197403 | uncultured symbiotic protist of *Cryptocercus punctulatus* | 1-19 | 20-445 | N/A | N/A |
| SEQ ID NO: 123 | 146197081 | uncultured symbiotic protist of *Reticulitermes speratus* | 1-22 | 23-443 | N/A | N/A |
| SEQ ID NO: 124 | 146197413 | uncultured symbiotic protist of *Cryptocercus punctulatus* | 1-19 | 20-445 | N/A | N/A |
| SEQ ID NO: 125 | 146197309 | uncultured symbiotic protist of *Mastotermes darwiniensis* | 1-20 | 21-435 | N/A | N/A |
| SEQ ID NO: 126 | 146197227 | uncultured symbiotic protist of *Neotermes koshunensis* | 1-19 | 20-437 | N/A | N/A |
| SEQ ID NO: 127 | 146197253 | uncultured symbiotic protist of *Neotermes koshunensis* | 1-21 | 21-442 | N/A | N/A |
| SEQ ID NO: 128 | 146197099 | uncultured symbiotic protist of *Reticulitermes speratus* | 1-22 | 23-434 | N/A | N/A |
| SEQ ID NO: 129 | 146197409 | uncultured symbiotic protist of *Cryptocercus punctulatus* | 1-19 | 20-444 | N/A | N/A |

TABLE 3-continued

| SEQ ID NO: | Database Accession Number | Species of Origin | Signal sequence (SS) start and end position | Catalytic Domain (CD) start and end position | Linker start and end position | Cellulose Binding Domain (CBD) start and end |
|---|---|---|---|---|---|---|
| SEQ ID NO: 130 | 146197315 | uncultured symbiotic protist of *Mastotermes darwiniensis* | 1-20 | 21-435 | N/A | N/A |
| SEQ ID NO: 131 | 146197411 | uncultured symbiotic protist of *Cryptocercus punctulatus* | 1-19 | 20-445 | N/A | N/A |
| SEQ ID NO: 132 | 146197161 | uncultured symbiotic protist of *Hodotermopsis sjoestedti* | 1-20 | 21-446 | N/A | N/A |
| SEQ ID NO: 133 | 146197323 | uncultured symbiotic protist of *Mastotermes darwiniensis* | 1-20 | 21-435 | N/A | N/A |
| SEQ ID NO: 134 | 146197077 | uncultured symbiotic protist of *Reticulitermes speratus* | 1-21 | 22-448 | N/A | N/A |
| SEQ ID NO: 135 | 146197089 | uncultured symbiotic protist of *Reticulitermes speratus* | 1-22 | 23-433 | N/A | N/A |
| SEQ ID NO: 136 | 146197091 | uncultured symbiotic protist of *Reticulitermes speratus* | 1-22 | 23-434 | N/A | N/A |
| SEQ ID NO: 137 | 146197097 | uncultured symbiotic protist of *Reticulitermes speratus* | 1-22 | 23-435 | N/A | N/A |
| SEQ ID NO: 138 | 146197095 | uncultured symbiotic protist of *Reticulitermes speratus* | 1-22 | 23-435 | N/A | N/A |
| SEQ ID NO: 139 | 146197401 | uncultured symbiotic protist of *Cryptocercus punctulatus* | 1-19 | 20-445 | N/A | N/A |
| SEQ ID NO: 140 | 146197225 | uncultured symbiotic protist of *Neotermes koshunensis* | 1-19 | 20-437 | N/A | N/A |
| SEQ ID NO: 141 | 146197317 | uncultured symbiotic protist of *Mastotermes darwiniensis* | 1-20 | 21-435 | N/A | N/A |
| SEQ ID NO: 142 | 146197251 | uncultured symbiotic protist of *Neotermes koshunensis* | 1-19 | 20-437 | N/A | N/A |
| SEQ ID NO: 143 | 146197319 | uncultured symbiotic protist of *Mastotermes darwiniensis* | 1-20 | 21-435 | N/A | N/A |
| SEQ ID NO: 144 | 146197071 | uncultured symbiotic protist of *Reticulitermes speratus* | 1-25 | 26-435 | N/A | N/A |
| SEQ ID NO: 145 | 146197075 | uncultured symbiotic protist of *Reticulitermes speratus* | 1-22 | 23-435 | N/A | N/A |
| SEQ ID NO: 146 | 146197159 | uncultured symbiotic protist of *Hodotermopsis sjoestedti* | 1-23 | 24-443 | N/A | N/A |
| SEQ ID NO: 147 | 146197405 | uncultured symbiotic protist of *Cryptocercus punctulatus* | 1-19 | 20-445 | N/A | N/A |
| SEQ ID NO: 148 | 146197327 | uncultured symbiotic protist of *Mastotermes darwiniensis* | 1-20 | 21-441 | N/A | N/A |

TABLE 3-continued

| SEQ ID NO: | Database Accession Number | Species of Origin | Signal sequence (SS) start and end position | Catalytic Domain (CD) start and end position | Linker start and end position | Cellulose Binding Domain (CBD) start and end |
|---|---|---|---|---|---|---|
| SEQ ID NO: 149 | 146197261 | uncultured symbiotic protist of *Neotermes koshunensis* | 1-19 | 20-437 | N/A | N/A |

TABLE 4

| Sequence Identifier (SEQ ID NO:) | Database Accession Number | Species of Origin | Amino acid sequence of fragment of catalytic domain including loop and catalytic residue | Amino acid positions of fragment in sequence identifer | Amino acid positions of active site loop residues in sequence identifier | Position of catalytic residues in sequence identifier |
|---|---|---|---|---|---|---|
| SEQ ID NO: 150 | BD29555* | Unknown | NVEGWTPSSNNANTGLGNHGACCAELDIWEANS | 210-242 | 214-226 | 234, 239 |
| SEQ ID NO: 151 | 340514556 | Trichoderma reesei | NVEGWTPSANNANTGIGNHGACCAELDIWEANS | 205-237 | 209-221 | 229, 234 |
| SEQ ID NO: 152 | 51243029 | Penicillium occitanis | NVEGWEPSSNNANTGIGGHGSCCSEMDIWEANS | 210-242 | 214-226 | 234, 239 |
| SEQ ID NO: 153 | 7cel (PDB) | Trichoderma reesei | NVEGWEPSSNNANTGIGGHGSCCSEMDIWQANS | 188-220 | 192-204 | 212, 217 |
| SEQ ID NO: 154 | 67516425 | Aspergillus nidulans FGSC A4 | NVEGWESSDTNPNGGVGNHGSCCAEMDIWEANS | 211-243 | 215-227 | 235, 240 |
| SEQ ID NO: 155 | 46107376 | Gibberella zeae PH-1 | NSDGWQPSDSDVNGGIGNLGTCCPEMDIWEANS | 205-237 | 209-221 | 229, 234 |
| SEQ ID NO: 156 | 70992391 | Aspergillus fumigatus Af293 | NVEGWQPSSNDANAGTGNHGSCCAEMDIWEANS | 214-246 | 218-230 | 238, 243 |
| SEQ ID NO: 157 | 121699984 | Aspergillus clavatus NRRL 1 | NVEGWTPSSSDANAGNGGHGSCCAEMDIWEANS | 214-246 | 218-230 | 238, 243 |
| SEQ ID NO: 158 | 1906845 | Claviceps purpurea | NSKDWIPSKSDANAGIGSLGACCREMDIWEANN | 206-238 | 210-222 | 230, 235 |
| SEQ ID NO: 159 | 1gpi (PDB) | Phanerochaete chrysosporium | NVGNWTETG--SNTGTGSYGTCCSEMDIWEANN | 185-215 | 189-199 | 207, 212 |
| SEQ ID NO: 160 | 119468034 | Neosartorya fischeri NRRL 181 | NVEGWKPSSNDKNAGVGGHGSCCPEMDIWEANS | 202-234 | 206-218 | 226, 231 |
| SEQ ID NO: 161 | 7804883 | Leptosphaeria maculans | NVEGWQPSKNDQNAGVGGHGSCCAEMDIWEANS | 193-225 | 197-209 | 217, 222 |
| SEQ ID NO: 162 | 85108032 | Neurospora crassa N150 (OR74A) | NVEGWTPSTNDANAGIGDHGTCCSEMDIWEANK | 205-237 | 209-221 | 229, 234 |
| SEQ ID NO: 163 | 169859458 | Coprinopsis cinerea okayama | NSADWTPSETDPNAGRGRYGICCAEMDIWEANS | 207-239 | 211-223 | 231, 236 |
| SEQ ID NO: 164 | 154292161 | Botryotinia fuckeliana B05-10 | NVEGWVPDSNSANSGTGNIGSCCSEFDVWEANS | 203-235 | 207-219 | 227, 232 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop in sequence identifier | Position of catalytic residues in sequence identifier |
|---|---|---|---|---|---|---|
| SEQ ID NO: 165 | 169615761 # | Phaeosphaeria nodorum SN15 | NADGWQASTSDPNAGVGKKGACCAEIDVWEANS | 183-215 | 187-199 | 207, 212 |
| SEQ ID NO: 166 | 4883502 | Humicola grisea | NIEGWRPSTNDPNAGVGPMGACCAEIDVWESNA | 208-240 | 212-224 | 232, 237 |
| SEQ ID NO: 167 | 950686 | Humicola grisea | NIEGWTGSTNDPNAGAGRYGTCCSEMDIWEANN | 207-239 | 211-223 | 231, 236 |
| SEQ ID NO: 168 | 124491660 | Chaetomium thermophilum | NIEGWRPSTNDANAGVGPYGACCAEIDVWESNA | 209-241 | 213-225 | 233, 238 |
| SEQ ID NO: 169 | 58045187 | Chaetomium thermophilum | NIENWTPSTNDANAGFGRYGSCCSEMDIWEANN | 207-239 | 211-223 | 231, 236 |
| SEQ ID NO: 170 | 169601100 # | Phaeosphaeria nodorum SN15 | NVEGWKPSDNDANAGVGGHGSCCAEMDIWEANS | 174-206 | 178-190 | 198, 203 |
| SEQ ID NO: 171 | 169870197 | Coprinopsis cinerea okayama | NSVGWEPSETDSNAGRGRYGICCAEMDIWEANS | 207-239 | 211-223 | 231, 236 |
| SEQ ID NO: 172 | 3913806 | Agaricus bisporus | NSEGWEGSPNDVNAGTGNFGACCGEMDIWEANS | 203-235 | 207-219 | 227, 232 |
| SEQ ID NO: 173 | 169611094 | Phaeosphaeria nodorum SN15 | NVEGWNPSDADPNAGSGKIGACCPEMDIWEANS | 208-240 | 212-224 | 232, 237 |
| SEQ ID NO: 174 | 3131 | Phanerochaete chrysosporium | NVQGWNATS--ATTGTGSYGSCCTELDIWEANS | 204-234 | 208-218 | 226, 231 |
| SEQ ID NO: 175 | 70991503 | Aspergillus fumigatus Af293 | NVEGWEPSSSDKNAGVGGHGSCCPEMDIWEANS | 202-234 | 206-218 | 226, 231 |
| SEQ ID NO: 176 | 294196 | Phanerochaete chrysosporium | NVEGWNATS--ANAGTGNYGTCCTEMDIWEANN | 203-233 | 207-217 | 225, 230 |
| SEQ ID NO: 177 | 18997123 | Thermoascus aurantiacus | NVEGWQPSANDPNAGVGNHGSSCCAEMDVWEANS | 205-237 | 209-221 | 229, 234 |
| SEQ ID NO: 178 | 4204214 | Humicola grisea var thermoidea | NIEGWRPSTNDPNAGVGPMGACCAEIDVWESNA | 208-240 | 212-224 | 232, 237 |
| SEQ ID NO: 179 | 34582632 | Trichoderma viride (also known as Hypochrea rufa) | NVEGWEPSSNNANTGIGHGSCCSEMDIWEANS | 205-237 | 209-221 | 229, 234 |
| SEQ ID NO: 180 | 156712284 | Thermoascus aurantiacus | NVEGWQPSANDPNAGVGNHGSCCAEMDVWEANS | 205-237 | 209-221 | 229, 234 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop in sequence identifer | Position of catalytic residues in sequence identifier |
|---|---|---|---|---|---|---|
| SEQ ID NO: 181 | 39977899 | Magnaporthe grisea (oryzae) 70-15 | NVEGWQPSSGDANSGVGNMGSCCAEMDIWEANS | 205-237 | 209-221 | 229, 234 |
| SEQ ID NO: 182 | 20986705 | Talaromyces emersonii | NVEGWQPSSNNANTGIGDHGSCCAEMDVWEANS | 203-235 | 207-219 | 227, 232 |
| SEQ ID NO: 183 | 22138843 | Aspergillus oryzae | R-KGWEPSDSDKNAVGVGHGSCCPQMDIWEANS | 203-234 | 206-218 | 226, 231 |
| SEQ ID NO: 184 | 55775695 | Penicillium chrysogenum | NVEGWEPSSSDVNGGTGNYGSCCAEMDIWEANS | 213-245 | 217-229 | 237, 242 |
| SEQ ID NO: 185 | 171676762 | Podospora anserina | NIEGWNPSTNDVNAGAGRYGTCCSEMDIWEANN | 207-239 | 211-223 | 231, 236 |
| SEQ ID NO: 186 | 146350520 | Pleurotus sp Florida | NVQGWQPSPNDSNAGKGQYGSCCAEMDIWEANS | 207-239 | 211-223 | 231, 236 |
| SEQ ID NO: 187 | 37732123 | Gibberella zeae | NSDGWQPSDSDVNGGIGNLGTCCPEMDIWEANS | 205-237 | 209-221 | 229, 234 |
| SEQ ID NO: 188 | 156055188 | Sclerotinia sclerotiorum 1980 | NNEGWVPDSNSANSGTGNIGSCCSEFDVWEANS | 203-235 | 207-219 | 227, 232 |
| SEQ ID NO: 189 | 453224 | Phanerochaete chrysosporium | NVGNWTETG--SNTGTGSYGTCCSEMDIWEANN | 203-233 | 207-217 | 225, 230 |
| SEQ ID NO: 190 | 50402144 | Trichoderma reesei | NVEGWEPSSNNANTGIGHGSCCSEMDIWEANS | 205-237 | 209-221 | 229, 234 |
| SEQ ID NO: 191 | 115397177 | Aspergillus terreus NIH2624 | NVEGWEPSANDANAGTGNHGSCCAEMDIWEANS | 211-243 | 215-227 | 235, 240 |
| SEQ ID NO: 192 | 154312003 | Botryotinia fuckeliana B05-10 | NSVGWTPSSNDVNAGAGQYGSCCSEMDIWEANK | 206-238 | 210-222 | 230, 235 |
| SEQ ID NO: 193 | 49333365 | Volvariella volvacea | NVQGWQPSPNDTNAGTGNYGACCNEMDVWEANS | 207-239 | 211-223 | 231, 236 |
| SEQ ID NO: 194 | 729650 | Penicillium janthinellum | NVDGWTPSKNDVNSGIGNHGSCCAEMDIWEANS | 211-243 | 215-227 | 235, 240 |
| SEQ ID NO: 195 | 146424871 | Pleurotus sp Florida | NILDWSASATDANAGNGRYGACCAEMDIWEANS | 206-238 | 210-222 | 230, 235 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop residues in sequence identifier | Position of catalytic residues in sequence identifier |
|---|---|---|---|---|---|---|
| SEQ ID NO: 196 | 67538012 | Aspergillus nidulans FGSC A4 | NVEGWEPSDSDANAGVGGMGTCCPEMDIWEANS | 202-234 | 206-218 | 226, 231 |
| SEQ ID NO: 197 | 62006162 | Fusarium poae | NSDGWEPSKSDVNGGIGNLGTCCPEMDIWEANS | 205-237 | 209-221 | 229, 234 |
| SEQ ID NO: 198 | 146424873 | Pleurotus sp Florida | NILDWSGSATDPNAGNGRYGACCAEMDIWEANS | 206-238 | 210-222 | 230, 235 |
| SEQ ID NO: 199 | 295937 | Trichoderma viride | NVEGWEPSSNNANTGIGHGSCCSEMDIWEANS | 205-237 | 209-221 | 229, 234 |
| SEQ ID NO: 200 | 6179889 # | Alternaria alternata | NVEGWKPSSNDANAGVGGHGSCCAEMDIWEANS | 177-209 | 181-193 | 201, 206 |
| SEQ ID NO: 201 | 119483864 | Neosartorya fischeri NRRL 181 | NVEGWTPSSNNENTGLGNYGSCCAELDIWESNS | 215-247 | 219-231 | 239, 244 |
| SEQ ID NO: 202 | 85083281 | Neurospora crassa OR74A | NIEGWTPSTNDANAGVPYGGCCAEIDVWESNA | 207-239 | 211-223 | 231, 236 |
| SEQ ID NO: 203 | 3913803 | Cryphonectria parasitica | NVEGWTPSTNDANAGVGLGSCCSEMDVWEANS | 206-238 | 210-222 | 230, 235 |
| SEQ ID NO: 204 | 60729633 | Corticium rolfsii | NLLDWNATS--ANSGTGSYGSCCPEMDIWEANK | 206-236 | 210-220 | 228, 233 |
| SEQ ID NO: 205 | 39971383 | Magnaporthe grisea 70-15 | NIEGWQPSSTDSSAGIGAQGACCAEIDIWESNK | 205-237 | 209-221 | 229, 234 |
| SEQ ID NO: 206 | 39973029 | Magnaporthe grisea 70-15 | NVEGWKPSSNDANAGVPYGACCAEIDVWESNA | 206-238 | 210-222 | 230, 235 |
| SEQ ID NO: 207 | 1170141 | Fusarium oxysporum | NSEGWKPSDSDVNAGVGNLGTCCPEMDIWEANS | 205-237 | 209-221 | 229, 234 |
| SEQ ID NO: 208 | 121710012 | Aspergillus clavatus NRRL 1 | NVEGWKPSDNDKNAGVGVGSCCPEMDIWEANS | 202-234 | 206-218 | 226, 231 |
| SEQ ID NO: 209 | 17902580 | Penicillium funiculosum | NVEGWTPSTNNSNTGIGNHGSCCAELDIWEANS | 210-242 | 214-226 | 234, 239 |
| SEQ ID NO: 210 | 1346226 | Humicola grisea var thermoidea | NIEGWTGSTNDPNAGAGRYGTCCSEMDIWEANN | 207-239 | 211-223 | 231,236 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifer | Amino acid positions of active site loop residues in sequence identifier | Position of catalytic residues in sequence identifier |
|---|---|---|---|---|---|---|
| SEQ ID NO: 211 | 156712282 | Chaetomium thermophilum | NVGNWTPSTNDANAGFGRYGSCCSEMDVWEANN | 207-239 | 211-223 | 231, 236 |
| SEQ ID NO: 212 | 169768818 | Aspergillus oryzae RIB40 | NVEGWVSSTNNANTGTGNHGSCCAELDWESNS | 214-246 | 218-230 | 238, 243 |
| SEQ ID NO: 213 | 46241270 | Gibberella pulicaris | NSDGWQFSKSDVNAGIGNMGTCCPEMDIWEANS | 205-237 | 209-221 | 229, 234 |
| SEQ ID NO: 214 | 49333363 | Volvariella volvacea | NVAGWNGSPNDTNAGTGNWGACCNEMDIWEANS | 205-237 | 209-221 | 229, 234 |
| SEQ ID NO: 215 | 46395332 | Irpex lacteus | NVAGWTGSSSDPNSGTGNYGTCCSEMDIWEANS | 202-234 | 206-218 | 226, 231 |
| SEQ ID NO: 216 | 50844407 # | Chaetomium thermophilum var thermophilum | NIENWTPSTNDANAGFGRYGSCCSEMDIWEANN | 182-214 | 186-198 | 206, 211 |
| SEQ ID NO: 217 | 4586347 | Irpex lacteus | NIVDWTASAGDANSGTGSFGTCCQEMDIWEANS | 203-235 | 207-219 | 227, 232 |
| SEQ ID NO: 218 | 3980202 | Phanerochaete chrysosporium | NVGNWTETG--SNTGTGSYGTCCSEMDIWEANN | 203-233 | 207-217 | 225, 230 |
| SEQ ID NO: 219 | 27125837 | Melanocarpus albomyces | NIEGWKSSTSDPNAGVGPYGSCCAEIDVWESNA | 210-242 | 214-226 | 234, 239 |
| SEQ ID NO: 220 | 171696102 | Podospora anserina | NVEGWGGAD--GNSGTGKYGICCAEMDIWEANS | 206-236 | 210-220 | 228, 233 |
| SEQ ID NO: 221 | 3913802 | Cochliobolus carbonum | NVEGWNPSDADPNGGAGKIGACCPEMDIWEANS | 208-240 | 212-224 | 232, 237 |
| SEQ ID NO: 222 | 50403723 | Trichoderma viride | NVEGWEPSSNNANTGIGHGSCCSEMDIWEANS | 205-237 | 209-221 | 229, 234 |
| SEQ ID NO: 223 | 3913798 | Aspergillus aculeatus | NIEGWEPSSTDVNAGTGNHGSCCPEMDIWEANS | 210-242 | 214-226 | 234, 239 |
| SEQ ID NO: 224 | 66828465 | Dictyostelium discoideum | NVDGWIPSTNNPNTGYGNLGSCCAEMDLWEANN | 206-238 | 210-222 | 230, 235 |
| SEQ ID NO: 225 | 156060391 | Sclerotinia sclerotiorum 1980 | NSVGWTPSSNDVNTGTGQYGSCCSEMDIWEANK | 192-224 | 196-208 | 216, 221 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop in sequence identifier | Position of catalytic residues in sequence identifier |
|---|---|---|---|---|---|---|
| SEQ ID NO: 226 | 116181754 | Chaetomium globosum CBS 148-51 | NSEGWGGED--GNSGTGKYGTCCA<u>E</u>MDIW<u>E</u>ANL | 203-233 | 207-217 | 225, 230 |
| SEQ ID NO: 227 | 145230535 | Aspergillus niger | NCDGWFPSSNNVNTGVGDHGSCCA<u>E</u>MDVW<u>E</u>ANS | 209-241 | 213-225 | 233, 238 |
| SEQ ID NO: 228 | 46241266 | Nectria haematococca mpVI | NSDEWKFSDSDKNAGVGKYGTCCP<u>E</u>MDIW<u>E</u>ANK | 205-237 | 209-221 | 229, 234 |
| SEQ ID NO: 229 | 1q9h (PDB) # | Talaromyces emersonii | NVEGWQPSSNNANTGIGDHGSCCA<u>E</u>MDVW<u>E</u>ANS | 185-217 | 189-201 | 209, 214 |
| SEQ ID NO: 230 | 157362170 | Polyporus arcularius | NVLDWAGSSNDPNAGTGHYGTCN<u>E</u>MDIW<u>E</u>ANS | 208-240 | 212-224 | 232, 237 |
| SEQ ID NO: 231 | 7804885 | Leptosphaeria maculans | NAEGWTKSASDPNSGVGKKGACCA<u>Q</u>MDVW<u>E</u>ANS | 204-236 | 208-220 | 228, 233 |
| SEQ ID NO: 232 | 121852 | Phanerochaete chrysosporium | NVEGWNATS--ANAGTGNYGTCCT<u>E</u>MDIW<u>E</u>ANN | 203-233 | 207-217 | 225, 230 |
| SEQ ID NO: 233 | 126013214 | Penicillium decumbens | NVEGWKPSANDKNAGVGPHGSCCA<u>E</u>MDIW<u>E</u>ANS | 201-233 | 205-217 | 225, 230 |
| SEQ ID NO: 234 | 156048578 | Sclerotinia sclerotiorum 1980 | NVDGWVFPSSNNPNTGVGNYGSCCA<u>E</u>MDIW<u>E</u>ANS | 202-234 | 206-218 | 226, 231 |
| SEQ ID NO: 235 | 156712278 | Acremonium thermophilum | NIDGWQPSNDANAGLGNHGSCCS<u>E</u>MDIW<u>E</u>ANK | 206-238 | 210-222 | 230, 235 |
| SEQ ID NO: 236 | 21449327 | Aspergillus nidulans (also known as Emericella nidulans) | NVEGWFPSDSDANAGVGGMGTCCP<u>E</u>MDIW<u>E</u>ANS | 202-234 | 206-218 | 226, 231 |
| SEQ ID NO: 237 | 171683762 | Podospora anserine (S mat+) | NIEGWRESSNDENAGVGPYGGCCA<u>E</u>IDVW<u>E</u>SNA | 211-243 | 215-227 | 235, 240 |
| SEQ ID NO: 238 | 56718412 | Thermoascus aurantiacus var levisporus | NVEGWQPSANDPNAGVGNHGSCCA<u>E</u>MDVW<u>E</u>ANS | 205-237 | 209-221 | 229, 234 |
| SEQ ID NO: 239 | 15824273 | Pseudotrichonympha grassii | NVENWKPQTNDENAGNGRYGACCT<u>E</u>MDIW<u>E</u>ANK | 200-232 | 204-216 | 224, 229 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifer | Amino acid positions of active site loop in sequence identifer | Position of catalytic residues in sequence identifier |
|---|---|---|---|---|---|---|
| SEQ ID NO: 240 | 115390801 | Aspergillus terreus NIH2624 | NVEGWTPSDNDKNAGVGGHGSCCPELDIWEANS | 203-235 | 207-219 | 227, 232 |
| SEQ ID NO: 241 | 453223 | Phanerochaete chrysosporium | NVGNWTETG--SNTGTGSYGTCCSEMDIWEANN | 203-233 | 207-217 | 225, 230 |
| SEQ ID NO: 242 | 3132 | Phanerochaete chrysosporium | NVEGWLGTT--ATTGTGFFGSCCTDIALWEAND | 202-232 | 206-216 | 224, 229 |
| SEQ ID NO: 243 | 16304152 | Thermoascus aurantiacus | NVEGWQPSANDPNAGVGNHGSSCAEMDVWEANS | 205-237 | 209-221 | 229, 234 |
| SEQ ID NO: 244 | 156712280 | Acremonium thermophilum | NSASWQPSSNDQNAGVGGMGSSCAEMDIWEANS | 210-242 | 214-226 | 234, 239 |
| SEQ ID NO: 245 | 5231154 | Volvariella volvacea | NVQGWQPSPNDTNAGTGNYGACCNKMDVWEANS | 220-252 | 224-236 | 244, 249 |
| SEQ ID NO: 246 | 116200349 | Chaetomium globosum CBS 148-51 | NYDGWTPSSNDANAGVGALGGCCAEIDVWESNA | 207-239 | 211-223 | 231, 236 |
| SEQ ID NO: 247 | 4586343 | Irpex lacteus | NVAGWAGSASDPNAGSGTLGTCCSEMDIWEANN | 202-234 | 206-218 | 226, 231 |
| SEQ ID NO: 248 | 15321718 | Lentinula edodes | NVEGWTPSSTSPNAGTGVTGTGICNEMDIWEANS | 208-240 | 212-224 | 232, 237 |
| SEQ ID NO: 249 | 146424875 | Pleurotus sp Florida | NVLDWSASATDDNAGNGRYGACCAEMDIWEANS | 206-238 | 210-222 | 230, 235 |
| SEQ ID NO: 250 | 62006158 | Fusarium venenatum | NSDGWQPSKSDVNGGIGNLGTCCPEMDIWEANS | 205-237 | 209-221 | 229, 234 |
| SEQ ID NO: 251 | 296027 | Phanerochaete chrysosporium | NVEGWNATS--ANAGTGNYGTCCTEMDIWEANN | 203-233 | 207-217 | 225, 230 |
| SEQ ID NO: 252 | 154449709 | Fusicoccum sp BCC4124 | NVQNWTASSTDKNAGTGHYGSCCNEMDIWEANS | 209-241 | 213-225 | 233, 238 |
| SEQ ID NO: 253 | 169859460 | Coprinopsis cinerea okayama | NSVGWEPSETDPNAGKGQYGICCAEMDIWEANS | 207-239 | 211-223 | 231, 236 |
| SEQ ID NO: 254 | 50400675 | Trichoderma harzianum (anamorph of Hypocrea lixii) | NVEGWEPSSNNANTGVGGHGSCCSEMDIWEANS | 201-233 | 205-217 | 225, 230 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop residues in sequence identifier | Position of catalytic residues in sequence identifier |
|---|---|---|---|---|---|---|
| SEQ ID NO: 255 | 729649 | Neurospora crassa (OR74A) | NVEGWTPSTNDAN-GIGDHGSCSEMDIWEANK | 200-231 | 204-215 | 223, 228 |
| SEQ ID NO: 256 | 119472134 | Neosartorya fischeri NRRL 181 | NVEGWQPSSNDANAGTGNHGSCCAEMDIWEANS | 214-246 | 218-230 | 238, 243 |
| SEQ ID NO: 257 | 117935080 | Chaetomium thermophilum | NIEGWRPSTNDANAGVGPYGACCAEIDVWESNA | 209-241 | 213-225 | 233, 238 |
| SEQ ID NO: 258 | 154300584 | Botryotinia fuckeliana B05-10 | NVDGWVPSSNNANTGVGNHGSCCAEMDIWEANS | 202-234 | 206-218 | 226, 231 |
| SEQ ID NO: 259 | 15824271 | Pseudotrichonympha grassii | NVENWKPQTNDENAGNGRYGACCTEMDIWEANK | 200-232 | 204-216 | 224, 229 |
| SEQ ID NO: 260 | 4586345 | Irpex lacteus | NVEGWTGSSTDSNSGTGNYGTCCSEMDIWEANS | 202-234 | 206-218 | 226, 231 |
| SEQ ID NO: 261 | 46241268 | Gibberella avenacea | NSDGWKPSDSDINAGIGNMGTCCPEMDIWEANS | 205-237 | 209-221 | 229, 234 |
| SEQ ID NO: 262 | 6164684 | Aspergillus niger | NCDGWEPSSNNVNTGVGDHGSCCAEMDVWEANS | 209-241 | 213-225 | 233, 238 |
| SEQ ID NO: 263 | 6164682 | Aspergillus niger | NVDGWEPSSNNDNTGIGNHGSCCPEMDIWEANK | 203-235 | 207-219 | 227, 232 |
| SEQ ID NO: 264 | 33733371 | Chrysosporium luckowense US6573086-10 | NVENWQSTNDANAGTGKYGSCCSEMDVWEANN | 206-238 | 210-222 | 230, 235 |
| SEQ ID NO: 265 | 29160311 | Thielavia australiensis | NVEGWESSTNDANAGSGKYGSCCTEMDVWEANN | 206-238 | 210-222 | 230, 235 |
| SEQ ID NO: 266 | 146197087 | uncultured symbiotic protist of Reticulitermes speratus | NVDDWKPQDNDENSGNGKLGTCCSEMDIWEGNM | 197-229 | 201-213 | 221, 226 |
| SEQ ID NO: 267 | 146197237 | uncultured symbiotic protist of Neotermes koshunensis | NSEGWKPQSGDKNAGNGKYGSCCSEMDVWESNS | 200-232 | 204-216 | 224, 229 |
| SEQ ID NO: 268 | 146197067 | uncultured symbiotic protist of Reticulitermes speratus | NVDDWKPQDNDENSGNGKLGTCCSEMDIWEGNM | 197-229 | 201-213 | 221, 226 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifer | Amino acid positions of active site loop in sequence identifier | Position of catalytic residues in sequence identifier |
|---|---|---|---|---|---|---|
| SEQ ID NO: 269 | 146197407 | uncultured symbiotic protist of Cryptocercus punctulatus | NVLDWKPQSNDENSGNGRYGACCTEMDIWEANS | 198-230 | 202-214 | 222, 227 |
| SEQ ID NO: 270 | 146197157 | uncultured symbiotic protist of Hodotermopsis sjoestedti | NVEGWKPSDNDENAGTGKWGACCTEMDIWEANK | 201-233 | 205-217 | 225, 230 |
| SEQ ID NO: 271 | 146197403 | uncultured symbiotic protist of Cryptocercus punctulatus | NVLDWKPQSNDENSGNGRYGACCTEMDIWEANS | 198-230 | 202-214 | 222, 227 |
| SEQ ID NO: 272 | 146197081 | uncultured symbiotic protist of Reticulitermes speratus | NVDDWKPQDNDENSGDGKLGTCCSEMDIWEGNA | 197-229 | 201-213 | 221, 226 |
| SEQ ID NO: 273 | 146197413 | uncultured symbiotic protist of Cryptocercus punctulatus | NVLDWKPQSNDENSGNGRYGACCTEMDIWEANS | 198-230 | 202-214 | 222, 227 |
| SEQ ID NO: 274 | 146197309 | uncultured symbiotic protist of Mastotermes darwiniensis | NSDGWKPQSNDKNSGNGKYGSCCSEMDIWEANS | 196-228 | 200-212 | 220, 225 |
| SEQ ID NO: 275 | 146197227 | uncultured symbiotic protist of Neotermes koshunensis | NSDGWKPQKNDKNSGNGKYGSCCSEMDIWEANS | 195-227 | 199-211 | 219, 224 |
| SEQ ID NO: 276 | 146197253 | uncultured symbiotic protist of Neotermes koshunensis | NSEGWKPQSGDKNAGNGKYGSCCSEMDVWESNS | 200-232 | 204-216 | 224, 229 |
| SEQ ID NO: 277 | 146197099 | uncultured symbiotic protist of Reticulitermes speratus | NVLDWKPQSNDENAGTGRYGTCCTEMDIWEANS | 197-229 | 201-213 | 221, 226 |
| SEQ ID NO: 278 | 146197409 | uncultured symbiotic protist | NVLDWKPQSNDENSGNGRWGARCTEMDIWEANS | 198-230 | 202-214 | 222, 227 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop residues in sequence identifier | Position of catalytic residues in sequence identifier |
|---|---|---|---|---|---|---|
| | | of Cryptocercus punctulatus | | | | |
| SEQ ID NO: 279 | 146197315 | uncultured symbiotic protist of Mastotermes darwiniensis | NSDGWKPQSNDKNSGNGKYGSCCSEMDIWEANS | 196-228 | 200-212 | 220, 225 |
| SEQ ID NO: 280 | 146197411 | uncultured symbiotic protist of Cryptocercus punctulatus | NVLDWKPQSNDENSGNGRYGACCTEMDIWEANS | 198-230 | 202-214 | 222, 227 |
| SEQ ID NO: 281 | 146197161 | uncultured symbiotic protist of Hodotermopsis sjoestedti | NVQDWKPSDNDDNAGTGHYGACCTEMDIWEANK | 201-233 | 205-217 | 225, 230 |
| SEQ ID NO: 282 | 146197323 | uncultured symbiotic protist of Mastotermes darwiniensis | NSDGWKPQSNDKNSGNGKYGSCCSEMDIWEANS | 196-228 | 200-212 | 220, 225 |
| SEQ ID NO: 283 | 146197077 | uncultured symbiotic protist of Reticulitermes speratus | NVLDWKPQETDENSGNGRYGTCCTEMDIWEANS | 201-233 | 205-217 | 225, 230 |
| SEQ ID NO: 284 | 146197089 | uncultured symbiotic protist of Reticulitermes speratus | NVEDWKPQDNDENSGNGKLGTCCSEMDIWEGNA | 197-229 | 201-213 | 221, 226 |
| SEQ ID NO: 285 | 146197091 | uncultured symbiotic protist of Reticulitermes speratus | NVLDWKPQSNDENAGTGRYGTCCTEMDIWEANS | 197-229 | 201-213 | 221, 226 |
| SEQ ID NO: 286 | 146197097 | uncultured symbiotic protist of Reticulitermes speratus | NVDDWKPQDNDENSGNGKLGTCCSEMDIWEGNA | 197-229 | 201-213 | 221, 226 |
| SEQ ID NO: 287 | 146197095 | uncultured symbiotic protist of Reticulitermes speratus | NVDDWKPQDNDENSGNGKLGTCCSEMDIWEGNA | 197-229 | 201-213 | 221, 226 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop in sequence identifer | Position of catalytic residues in sequence identifier |
|---|---|---|---|---|---|---|
| SEQ ID NO: 288 | 146197401 | uncultured symbiotic protist of Cryptocercus punctulatus | NVLDWKPQSNDENSGNGRYGACCIEMDIWEANS | 198-230 | 202-214 | 222, 227 |
| SEQ ID NO: 289 | 146197225 | uncultured symbiotic protist of Neotermes koshunensis | NSDGWKPQKNDKNSGNGKYGSCCSEMDIWEANS | 195-227 | 199-211 | 219, 224 |
| SEQ ID NO: 290 | 146197317 | uncultured symbiotic protist of Mastotermes darwiniensis | NSDGWKPQSNDKNSGNGKYGSCCSEMDIWEANS | 196-228 | 200-212 | 220, 225 |
| SEQ ID NO: 291 | 146197251 | uncultured symbiotic protist of Neotermes koshunensis | NSDGWKPQKNDKNSGNGRYGSCCSEMDVWEANS | 195-227 | 199-211 | 219, 224 |
| SEQ ID NO: 292 | 146197319 | uncultured symbiotic protist of Mastotermes darwiniensis | NSDGWKPQSNDKNSGNGKYGSCCSEMDIWEANS | 196-228 | 200-212 | 220, 225 |
| SEQ ID NO: 293 | 146197071 | uncultured symbiotic protist of Reticulitermes speratus | NILDWKPSSNDENAGAGRYGTCCTEMDIWEANS | 200-232 | 204-216 | 224, 229 |
| SEQ ID NO: 294 | 146197075 | uncultured symbiotic protist of Reticulitermes speratus | NVDDWKPQDNDENSGNGKLGTCCSEMDIWEGNA | 197-229 | 201-213 | 221, 226 |
| SEQ ID NO: 295 | 146197159 | uncultured symbiotic protist of Hodotermopsis sjoestedti | NVKDWKPQETDENAGNGHYGACCTEMDIWEANS | 197-229 | 201-213 | 221, 226 |
| SEQ ID NO: 296 | 146197405 | uncultured symbiotic protist of Cryptocercus punctulatus | NVLDWKPQSNDENSGNGRYGACCTEMDIWEANS | 198-230 | 202-214 | 222, 227 |

TABLE 4-continued

| Sequence Identifier (SEQ ID NO:) | Database Accession Number | Species of Origin | Amino acid sequence of fragment of catalytic domain including loop and catalytic residue | Amino acid positions of fragment in sequence identifier | Amino acid positions of active site loop residues in sequence identifer | Position of catalytic residues in sequence identifier |
|---|---|---|---|---|---|---|
| SEQ ID NO: 297 | 146197327 | uncultured symbiotic protist of *Mastotermes darwiniensis* | NSDGWKPQDNDENSGNGKYGSCCSEMDIWEANS | 201-233 | 205-217 | 225, 230 |
| SEQ ID NO: 298 | 146197261 | uncultured symbiotic protist of *Neotermes koshunensis* | NSDGWKPQKNDKNSGNGKYGSCCSEMDIWEANS | 195-227 | 199-211 | 219, 224 |

TABLE 5

| Substitution(s) | Tolerance to 250 mg/L cellobiose % Activity in 4-MUL Assay (+/−Cellobiose)± | Tolerance to cellobiose accumulation % Activity in Bagasse Assay (−/+BG)¥ |
|---|---|---|
| None | 25% | 60% |
| R273K/R422K | 95% | 84% |
| R273K/Y274Q/D281K/Y410H/P411G/R422K | 78% | ND |

TABLE 6

| Substitution(s) | Tolerance to 250 mg/L cellobiose % Activity in 4-MUL Assay (+/−Cellobiose)± | Tolerance to cellobiose accumulation % Activity in Bagasse Assay (−/+BG)¥ |
|---|---|---|
| None | 23% | 74% |
| R268K/R411K | 92% | 94% |
| R268A/R411A | 92% | 95% |
| R268A/R411K | 97% | 94% |
| R268K/R411A | 97% | 102% |
| R268K | ND | 92% |
| R268A | ND | 86% |
| R411K | ND | 89% |
| R411A | ND | 94% |

TABLE 7

| SEQ ID NO. | Amino acid sequence |
|---|---|
| SEQ ID NO: 1 | MSALNSFNMY KSALILGSLL ATAGAQQIGT YTAETHPSLS WSTCKSGSGC TTNSGAITLD ANWRWVHGVN TSTNCYTGNT SCAQDCALDG ADYSGTYGIT TSGNSLRLNF VTGSNVGSRT YLMADNTHYQ IFDLLNQEFT FTVDVSHLPC GLNGALYFVT MDADGVSKY PNNKAGAQYG VGYCDSQCPR DLKFIAGQAN VEGWTPSSNN ANTGLGNHGA CCAELDIWEA NSISEALTPH PCDTPGLSVC TTDACGGTYS SDRYAGTCDP DGCDFNPYRL GVTDFYGSGK TVDTTKPITV VTQFVTDDGT STGTLSEIRR YYVQNGVVIP QPSSKISGVS GNVINSDFCD AEISTFGETA SFSKHGGLAK MGAGMEAGMV LVMSLWDDYS VNMLWLDSTY PTNATGTPGA ARGSCPTTSG DPKTVESQSG SSYVTFSDIR VGPFNSTFSG GSSTGGSSTT TASGTTTTKA SSTSTSSTST GTGVAAHWGQ CGGQGWTGPT TCASGTTCTV VNPYYSQCL |
| SEQ ID NO: 2 | MYRKLAVISA FLATARAQSA CTLQSETHPP LTWQKCSSGG TCTQQTGSVV IDANWRWTHA TNSSTNCYDG NTWSSTLCPD NETCAKNCCL DGAAYASTYG VTTSGNSLSI GFVTQSAQKN VGARLYLMAS DTTYQEFTLL GNEFSPDVDV SQLPCGLNGA LYFVSMDADG GVSKYPTNTA GAKYGTGYCD SQCPRDLKFI NGQANVEGWE PSSNNANTGI GGHGSCCSEM DIWEANSISE ALTHPCTTV GQEICEGDGC GGTYSDNRYG GTCDPDGCDW NPYRLGNTSF YGPGSSFTLD TTKKLTVVTQ FETSGAINRY VYQNGVTFQQ PNAELGSYSG NELNDDYCTA EEAEFGGSSF SDKGGLTQFK KATSGEMVIG MSLWDDSTYPT NETSSTPGSV RGSCSTSSGV PAQVESQSPN AKVTFSNIKP GPIGSTGNPS GGNPPGGNPP GTTTRRPAT TTGSSPGPTQ SHYGQCGGIG YSGPTVCASG TTCGVTCTV VNPYYSQCL |
| SEQ ID NO: 3 | MSALNSFNMY KSALILGSLL ATAGAQQIGT YTAETHPSLS WSTCKSGSGC TTNSGAITLD ANWRWVHGVN TSTNCYTGNT WNSAICDTDA SCAQDCALDG ADYSGTYGIT TSGNSLRLNF VTGSNVGSRT YLMADNTHYQ IFDLLNQEFT FTVDVSHLPC GLNGALYFVT MDADGVSKY PNNKAGAQYG VGYCDSQCPR DLKFIAGQAN VEGWTPSANN ANTGIGNHGA CCAELDIWEA NSISEALTPH PCDTPGLSVC TTDACGGTYS SDRYAGTCDP DGCDFNPYRL GVTDFYGSGK TVDTTKPFTV VTQFVTNDGT STGSLSEIRR YYVQNGVIP QPSSKISGIS GNVINSDYCA AEISTFGGTA SFNKHGGLTN MAAGMEAGM LVMSLWDDYA VNMLWLDSTY PTNATGTPGA ARGTCATTSG DPKTVESQSG SSYVTFSDIR VGPFNSTFSG GSSTGSTTT TASRTTTTSA SSTSTSSTST GTGVAGHWGQ CGGQGWTGPT TCVSGTTCTV VNPYYSQCL |
| SEQ ID NO: 4 | ESACTLQSET HPPLTWQKCS SGGTCTCQQTG SVVIDANWRW THATNASSTNC YDGNTWSSTL VDVSQLPCGL NGALYFVSMD ADGGVSKYPT TVVGQEICEG DGCGGTYSDN RYGGTCDPDG CDWNPYRLGN LSIDFVTQSA QKNVGARLYL MASDTTYQEF TLLGNEFSPD VYLMDDEDTY TMFYLLNKEF TFDVDVSELP CGLNGAVYFV SMDADGGKSR KFINGQANVE GWEPSSNNAN TGIGGHGSCC SEMDIWQANS ISEALTHPC FQQPNAELGS YSGNELNDDY CTAEREAEFGG SSFSDKGGLT QFKKATSGGM TSFYGPSGSF YGPGSSFTLD TTKKLTVVTQ FETSGAI NRYYVQNGVT PTNETSSTP GAVRGSCSTS SGVPAQVESQ SPNAKVTFSN IKFGPIGSTG NPSG VLVMSLWDDY YANMLWLDST YPTNETSSTP GAVRGSCSTS |
| SEQ ID NO: 5 | MASSFQLYKA LLFFSSLLSA VQAQKVGTQQ AEVHPGLITWQ TCTSSGSCTT VNGEVTIDAN WRWLHTVNGY TMFYLLNKEF TSICTSNEVC AEQCAVDGAN YASTYGITTS GSSLRLNFVT QSQKNIGSR RDLKFPINGVA NVEGWESSDT LTVDTNSPVT VVTQFLTDDN YSNMLWLDSN TFDVDVSELP CGLNGAVYFV SMDADGGKSR CTGDSCGGTY YATNEAGAKY GTGYCDSQCP PDGCDFNSYR QGNKTFYGPG GMGAALEQGM VLVLSLWDDN SSATSTATG QAQHWEQCGG NGWTGPTVCA SPWACTVVNS WYSQCL SNDRYGGTCD DVFSAHGGMA ESQKELFGDV IKFGPIGSTF GNGGGSGPTT TVTTSTATST HPCDTPGQTL PNSEBSTYPAN PGNSITTEFC SGVPSEVEAQ YPNAYVVVSN |
| SEQ ID NO: 6 | MYRAIATASA LIAAVRAQQV CSLTQESKEPS LNWSKCTSSG CSNVKGSVTI DANWRWTHQV SGSTNCYTGN KWDTSVCTSG KVCAEKCCLD GADYASTYGI TSSGDQLSLS FVTKGPYSTN IGSRTYLMED ENTYQMFQLL GNEFTFDVDV SNIGCGLNGA LYFVSMDADG GRAKYPGNKA GAKYGTGYCD AQCPRDFNKT NGQANSDGNG I PSDSDVNGGI GNLGTCCPEM DIWEANSIST AYTPHPCTKL TQHSCTGDSC GGTYSNDRYG GTCDADCGDF NSYRQGNKTF YGPGSGFNVD TTKKVTVTVTQ FHKGSNGRLS EITRLYVQNG KVIANSESKI AGVPGNSLTA DFCTKQKKVF NDPDDFTKKG AWSGMSDALE APMVLVMSLW HDHHSNMLWL DSTYPTDSTK LGSQRGSCST SSGVPADLLEK NVPNSKVAFS NIKFGPIGST YKSDGTTPTN PTNPSEPSNT ANPNPGTVDQ WGQCCGGSNYS GPTACKSGFT CKKINDFYSQ CQ |
| SEQ ID NO: 7 | MLASTFSYRM YKTALILAAL LGSGQAQQVG TSQAEVHPSM TMQSCTAGGS CTTNNGKVVI DANWRWVHKV GDYTNCYTGN TWDTTICPDD ATCASNCALE GANYESTYGV TASGNSLRLN FVTTSQQKNI GSRLYMMKDD STYEMFKLLN QEFTFDVDVS NLPCGLNGAL YFVAMDADGG MSKYPTNKAG AKYGTYCDS SCPRDLKFIN GQANVEGWQP SSNDANAGTG NHGSCCAEMD IWEANSISTA FTPHPCDTPG QVMCTGDACG GTYSSDRYGG TCDPDGCDFN SFRQGNKTFY GPGMTVDTKS KPTVTVQPFIT DDGTSSGTLK EIKRFYVQNG KVIPNSESTW TGVSGNSITT EYCTAQKSLF QDQNVPEKHG GLEGMAALA QGMVLVMSLW DDHSANMLWL DSNYPTTASS TTPGVARGTC DISSGVPADV EANHPDAYVV YSNIKVGPIG STFNSGGSNP GGGTTTTTTT QPTTTTTTAG NPGGTGVAQH YGQCCGGIGWT GPTTCASPYT CQKLNDYYSQ CL |

TABLE 7-continued

| SEQ ID NO. | Amino acid sequence |
|---|---|
| SEQ ID NO: 8 | MLPSTISYRI YKNALFFAAL FGAVOAQKVG TSKAEVHPSM AWQTCAADGT CTTKNGKVI DANWRWVHDV KGYTNCYTGN TWNAELCPDN ESCAENCALE GADYAATYGA TTSGNALSLK FVTQSQQKNI GSRLYMMKDD NTYEFKLLN QEFTFDVDVS NLPCGLNGAL YFVSMDADGG LSRYTGNEAG AKYGTGYCDS QCPRDLKFIN GLANVEGWTP SSSDANAGNG GHGSCCAEMD IWEANSISTA YTPHPCDTPG QAMCNGDSCG GTYSSDRYGG TCDPDGCDFN SYRQENKSFY GPGMTVDTKK KMTVVTQFLT NDGTATGTLS EIKRFYVQDG KVIANSESTW PNLGGNSLTN DFCKAQKTVF GDMDTFSKHG GMEGMGAALA EGMVLVMSLW DDHNSNMLWL DSNSPTTGTS TTPGVARGSC EANHPDASVV YSNIKVGPIG STFNSGGSNP GGSTTTTKPA TSTTTTKATT TATTNTTGPT GTGVAQPWAQ CGGIGYSGPT QCAAPYTCTK QNDYSQCL |
| SEQ ID NO: 9 | MHPSLQTILL SALFFTAHAQ QACSSKPETH PPLSWRCRSR SGCRSVGAV TVDANWLWTT VDGSQNCYTG NRWDTSICSS EKTCSESCCI DGADYAGTYG VTTTGDALSL KFVQOGPYSK NVGSRLYLMK DESRYEMPTL LGNEFTFDVD VSKLGCGLNG ALYFVSMDED GGMKRFPMNK AGAKFGTGYC DSQCPRDVKF INGMANSKDW IPSKSDANAG IGSLGACCRE MDIWEANNIA SAFTPHPCKN GKVIPNSVSR SAYHSCTGDG CGGTYSKNRY SGDCDPDGCD FNSYRLGNTT FYGPGPKFTI DTTRKISVVT QFLKGRDGSL REIKRFYVQN QRGSKRGSCP ASSGRPTDVE SSAPDSTVVF VRGVPGNSIT QGFCNAQKKM FGAHESFNAK GGMKGMSAAV SKPMVLVMSL WDDHNSNMLW LDSTYPTNSR SNIKFGPIGS TFSRGK |
| SEQ ID NO: 10 | ESACTLQSET HPPLTWQKCS SGGTCTQQTG SVVIDANWRW THATNSSTNC CPDNETCAKN CCLDGAAYAS TYGVTTSGNS LSIDFVTQSA QKNVGARLYL MASDTTYQEF TLLGNEFSFD VDVSQLPCGL NGALYFVSMD ADGGVSKYPT NTAGAKYGTG YCDSQCPRDL KFINGQANVE GWEPSSNNAN TGIGHGSCCS SEMDIWQANS ISEALTPHPC TTVGQEICEG DGCGGTYSDN RYGGTCDPDG CDWNPYRLGN TSFYGPCSSF TLDTIKKLTV VTQFETSGAI NRYYVQNGVT FQQPNAELGS YSGNELNDDY CTAEBAEFGG SSFSDKGGLT QFKKATSGGM VLVMSLWDDY YANMLWLDST YPTNETSSTP GAVRGSCSTS SGVPAQVESQ SPNAKVTFSN IKFGPIGSTG NPSG |
| SEQ ID NO: 11 | MHQRALLFSA LAVAANAQQV GTQKPETHPP LTWQKCTAAG SCSQQSGSVV IDANWRWLHS TKDTNCYTG NTWNTELCPD NESCAQNCAV DGADYAGTYG VTTSGSELKL SFVTGANVGS RLYLMQDDET YOHFNLLNNE FTFDVDVSNL PCGLNGALYF VAMDADGGMS KYPSNKAGAK YGTGYCDSQC PRDLKFINGM ANVEGWKPSS NDKNAGVGGH GSCCPEMDIW EANSISTAVT PHPCDDVSQT MCSGDACGGT YSATRYAGTC DPDGCDFNPF RMGNESFYGP GKIVDTKSEM TVVTQFITAD GTDTGALSEI KRLYQNGKV IANSVSNVAD VSGNSISSDF CTAQKKAFGD EDIFAKHGGL SGMGKALSEM VLIMSIWDDH HSSMMWLDST YPTDADPSKP GVARGTCEHG AGDPEKVESQ HPDASVTFSN IKFGPIGSTY KA |
| SEQ ID NO: 12 | MYRSLIFATS LLSLAKGQLV GNLYCKGSCT AKNGKVVIDA NWRWLHVKGG YTNCYTGNEW NATACPDNKS CATNCAIDGA DYRRLRHYCE RQLLGTEVHH QGLYSTNIGS RTYLMQDDST YQLFKFTGSQ EFTFDVDLSN LPCGLNGALY FVSMDADGGL KKYPTNKAGA KYGTGYCDAQ CPRDLKFING EGNVEGWQPS KNDQNAGVGG HGSCCAEMDI WEANSVSTAV TPHSCSTIEQ SRCDGDGCGG TYSADRYAGV CDPDGCDFNS YRMGVKDFYG KGKTVDTSKK FTVVTQFIGS GDAMEIKRFY VQNGKTIPQP DSTIPGVTGN SITTFFCDAQ KKAFGDKYTF KDKGGMANMP STCNGMVLVM SLWDDHYSNM LWLDSTYPTD KNPDITDAGSG RGECAITSGV PADVESQHPD ASVIYSNIKF GPINTITFG |
| SEQ ID NO: 13 | MLAKFAALLAA LVASANAQAV CSLITAETHPS LNWSKCTSSG CTNVAGSITV DANWRWTHIT SGSTNCYSGN EWDTSLCSTN TDCATKCCVD GAEYSSTYGI QTSGNSLSLQ FVTKGSYSTN IGSRTYLMNG ADAYQGFELL GDHGTCCSEM DIWEANKVST AFTPHPCTTI EQHMCEGDSC GTYSDDRYG GKAKYTNNKA GAKYGTGYCD AQCPRDLKYI NGIANVEGWT PSTNDANAGI KDSAGDLAEI KRFYVQNGKV YRGECPTTSG VSGNSITQSF CNAQKTAFGD GTCDADGCDF NSYRMGNTTF YGEGKTVDTS SKFTVVTQFI MVLVMSIWDD HAANMLWLDS TYPVEGGPGA AQCCGGIGFSG PTTCQSPYTC VPAEVEANAP NSKVIFSNIK FGPIGSTFSG IDDFNKKGGL KQMGKALAKP SSSVKPVTST AKPSSTSTAS NPSGTGAAHW QKINDYYSQC V GSSGTPPSNP |
| SEQ ID NO: 14 | MFKKVALTAL CFLAVAQAQQ VGREVAENHP RLPWQRCTRN GGCQTVSNGQ VVLDANWRWL HVTDGYTNCY TGNSWNSTVC SDPTTCAQRC ALEGANYQQT YGITTNGDAL TIKFLTRSQQ TNVGARVILM ENENRYQMFN LLNKEFTFDV DVSKVPCGIN GALYFIQMDA DGGMSKQPNN RAGAKYGTGY CDSQCPRDIK FIDGVANSAD WTPSETDPNA GRGRYGICCA EMDIWEANSI SNAYTPHPCR TQNDGGYQRC EGRDCNQPRY EGLCDDPDGC DYNPFRMGNKD FYGPGKTVDT NRKMTVVTQF DADPNKPGIA RGTCPTTSGT PRETEQNHPD AQVIFSNIKF GDIGSTFSGY RSLAKGHVLA LSIWNDHGAH MLWLDSNYPT LVDIRRLYVQ SITEQFCTDQ KNLFGDYSSF ARDGGLAHMG |
| SEQ ID NO: 15 | MYSAAVLATF SFLLGAGAQQ VGTSTAETHP ALTVQKCAAG GTCTDESDSI VLDANWRWLH STSGSTNCYT GNTWDTTLCP DAATCTTNCA LDGADYEGTY GITTSGDSLK LSFVTGSNVG SRTYLMDSET TYKEFALLGN EFTFTVDVSK WEANSMSQAL TPHVCTVDSQ SDISGVSGNS ITDDFCAAQK SKYPTNKAGA KYGTGYCDAQ CPQDMKFVNG TANVEGWVPD SNSANSGTGN IGSCCSEFDV TLTEIKRFYV QDDVVYEQPS GSCATDSGVP ATVEAASGSA YVIFSSIKYG NTGVCDGDGC TAFGDTYFT DFNPYRMGNT TFYGSGMTID TSKPFSVVTQ FITDDGTETG LWLDSDYPTT KDASTPGVSR PIGSTFNAPA QNGGMAAMGK KMADGMVLVL SIWDDYNVNM |

TABLE 7-continued

| SEQ ID NO. | Amino acid sequence |
|---|---|
| SEQ ID NO: 16 | MTWQRCTGTG GSSCTNVNGE IVIDANWRWI HATGGYTNCF DGNEWNKTAC PSNAACTKNC AIEGSDYRGT YGITTSGNSL TLKFITKGQY STNVGSRTYL MKDTNNYEMF NLIGNEFTFD VDLSQLPCGL NGALYFVSMP EKGQGTPGAK YGTGKLSQCS VHISKTLTDA CARDLKFVGG EANADGWQAS TSDPNAGVGK KGACCAEMDV WEANSMSTAL TPHSCQPEGY AVCEESNCGG NSITQKWCDT QKEVFKEEVY CDANGCDFNP YRVGNKDFYG KGKTVDTSKK MTVVTQFLGT GSDLTELKRF YVQDGKVLSN PEPTIPGMTG NSITQKWCDT QKEVFKEEVY PFNQWGGMAS MGKGMAQGMV LVMSLWDDHY SNMLWLDSTY PTDRDPESPG AARGECAITS GAPAEVEANN PDASVMFSNI KFGPIGSTFQ QPA |
| SEQ ID NO: 17 | MQIKSYIQYL AAALPLLSSV AAQQAGTITA ENHPRMTWKR CSGPGNCQTV QGEVVIDANW RWLHNNGQNC YEGNKWTSQC SSATDCAQRC ALDGANYQST YGASTSGDSL TLKFVTKHEY GTNIGSRFYL MANQNKYQMF TLMNNEFAFD VDLSKVECGI NSALYFVAME EDGGMASYPS NRAGAKYGTG YCDAQCARDL KFIGGKANIE GWRPSTNDPN AGVGPMGACC AEIDVWESNA YAYAFTPHAC GSKNRYHICE TNNCGGTYSD DRFAGYCDAN GCDYNPYRMG NKDFYGKANI VDTNRKFVSQ SRFERNRLSQ FFVQDGRKLP VPPPTWGLP NSADITPELC DAQFRVFDDR NRFAETGGFD ALNEALTIPM VLVMSIWDDH HSNMLWLDSS YPPEKAGLPG GDRGPCPTTS GPVAEVEAQY PNAQVVWSNI RFGPIGSTVN V |
| SEQ ID NO: 18 | MRTAKFPATLA ALVASAAAQQ ACSLITTERHP SLSWKKCTAG GQCQTVQASI TLDSNWRWTH QVSGSTNCYT GNKDTSICT DAKSCAQNCC VDGADYTSTY GITTNGDSLS LKFVTKGQYS TNVGSRTYLM DGEDKYQTFE LLGNEFTFDV DVSNIGCGLN GALYFVSMDA DGGLSRYPGN KAGAKYGTGY CDAQCPRDIK FINGEANIEG WTGSTNDPNA GAGRYGTCCS EMDIWEANNM ATAFTPHPCT IIGQSRCEGD SCGGTYSNER YAGVCDPDGC DFNSYRQGNK TFYGKGMTVD TTKKITVVTQ FLKDANGDLG EIKRFYVQDG KPGAERGACP TTSGVPAEVE AEAPNSNVVF DWCDRQKVAF GDIDDFNRKG GMKQMGKALA GPMVLVMSIW DDHASNMLWL DSTFPVDAAG AGRWQQCGGI GFTGPTQCEE PYTCKLNDW YSQCL SNIRFGPIGS TVAGLPGAGN GGNNGGNPPP PTTTTSSAPA TTTTASAGPK AGRWQQCGGI GFTGPTQCEE PYTCKLNDW YSQCL |
| SEQ ID NO: 19 | MQIKQYLQYL AAALPLVNMA AAQRAGTQQT ETHPRLSWKR CSSGGNCQTV NAEIVIDANW RWLHDSNYQN CYDGNRWTSA CSSATDCAQK CYLEGANYQS TYGVSTSGDA LTLKFVTKHE YGTNIGSRVY LMNGSDKYQM FTLMNNEFAF DVDLSKVECG LNSALYFVAM EEDGGMRSYS SNKAGAKYGT CDAQCARDL KFVGGKANI EGWRPSTNDA NAGVGPYGAC CAEIDVWESN AYAFAFTPHG CLNNNYHVCE TSNCGGTYSE DRFGGLCDAN GCDYNPYRMG NKDFYGKGKT VDTSRKFTVV TRFEENKLTQ FFIQDGRKID IPPPTWPGLP NSSAITPELC TNLSKVFDDR DRYEETGGFR TINEALRIPM VLVMSIWDGH YANMLWLDSV YPPEKAGOPG AERGPCAPTS GPVAEVEAQF PNAQVIWSNI RFGPIGSTYQ V |
| SEQ ID NO: 20 | MMYKKFAALA ALVAGAAAQQ ACSLTTETHP RLTWKRCTSG GNCSTVNGAV TIDANWRWTH TVSGGTNCYT GNEWDTSICS DGKSCAQTCC VDGADYSTSTY GITTSGDSLN LKFVTKHQHG TNVGSRVYLM ENDTKYQMFE LLGNEFTFDV DVSNLGCGLN GALYFVSMDA DGGMSKYGN KAGAKYGTGY CDAQCPRDLK FINGEANIEN WTPSTNDANA GFGRYGSCCS EMDIWDANNM ATAFTPHPCT IIGQSRCEGN PGNPGNSITQ SCGGTYSSER YAGVCDPDGC DFNAYRQGDK TFYGKGMTVD TTKKMTVVTQ FHKNSAGVLS EIKRFYVQDG TPGAERGACP TTSGVPAEIE AQVPNSNVIF EWCDAQKVAF GDIDDFNRKG GMAQMSKALE GPMVLVMSVW DDHYANMLWL DSTYPIDKAG QCGGIGYTGC TNCVAGTTCT ELNPWYSQCL SNIRFGPIGS TVPGLDGSTP SNPTATVAPP TSTTTSVRSS TTQISTPTSQ PGGCTTQKWG |
| SEQ ID NO: 21 | MYRNFLYAAS LLSVARSQLV GTQTETHPG MTWQSCTAKG SCTTCSDNKA CASNCAVDGA DYKGTYGITA SGNSLQLKFI TKGSYSTNIG SRTYLMASDT AYQMFKFDGN KEFTFDVDLS GLPCGFNGAL YFVSMDEDGG LKKYSGNKAG AKYGTGYCDA CCPRDLKFIN GEGNVEGWKP SDNDANAGVG GHGSCCAEMD IWEANSISTA VTPHACSTIE YVQGGKTIEQ PASTIPGVEG NSITTKFCDQ QTRCDGDCGG GTYSADRYAG QKQVFGDRYT YKEKGGTANM AKALAQGMVL VMSLWDDHYS NMLWLDDHYS TDKNPDTDLG KFTVVTQFIG TGDAMEIKRF YVQGGKTIEQ PASTIPGVEG NSITTKFCDQ KFGPLNSTY SGRGSCDVKS GAPADVESKS PDATVIYSNI KFGPLNSTY |
| SEQ ID NO: 22 | MLGKIAIASL SFLAIAKGQQ VGREVAENHP RLPMQRCTRN GGCQTVSNGQ VVLDANWRWL HVTDGYTNCY TGNSWNSSVC SDGTTCAQRC ALEGANYQQT YGITTSGNSL TMKFLTRSQG TNVGGRVYLM WEPSETDSNA ENENRYQMFN LLNKEFTFDV DVSKVPCGIN GALYFIQMDA DGGMSSQPNN EGRDCNQPRY RAGAKYGTGY CDSQCPRDIK FIDGVANSVG FYGPGKTIDT NRKMTVVTQF ITHDNTDTGT LVDIRRLYVQ DGRVIANPPT TQNDGGYQRC NFPGLMPAHD STTEQFCTDQ EGLCDDPDGC YNPFRMGNKD ARDGGLAHMG RSLAKGHVLA LSIWNDHGAH MLWLDSNYPT DADPNKPGIA RGTCPTTGGT PRETEQNHPD AQVIFSNIKF KNLFGDYSSF GDIGSTPSGY |
| SEQ ID NO: 23 | MFPPRSILLAL SLTAVALGQQ VGTNMAENHP SLTWQRCTSS GCQNVNGKVT LDANWRWTHR INDFTNCYTG NEWDTSICPD GVTCAENCAL DGADYAGTYG VTSSGTALTL KFVTESQQKN IGSRLYLMAD DSNYEIFNLL NKEFTFDVDV SKLPCGLNGA LYFSEMAADG GMSSTNTAGA KYGTGYCDSQ CPRDIKFIDG EANSEGWGS PNDVNAGTGN FGACCGEMDI WEANSISSAY TPHPCREPGL QRCEGNTCSV NDRYATECDP |

TABLE 7-continued

| SEQ ID NO. | Amino acid sequence |
|---|---|
| SEQ ID NO: 24 | DGCDFNSFRM GDKSFYGPGM TVDTNQPITV VTQPFITDNGS DNGNLQEIRR IYVQNGQVIQ NSNVNIPGID SGNSISAEFC DQAKEAFGDE RSFQDRGGLS GMGSALDRGM VLVLSIWDDH AVNMLWLSD YPLDASPSQP GISRGTCSRD SGKPEDVEAN AGGVQVVYSN IKFGDINSTF NNNGGGGNP SPTTTRPNSP AQTMWGQCGG QGWTGPTACQ SPSTCHVIND FYSQCF |
| SEQ ID NO: 25 | MYRNLALASL SLFGAARAQQ AGTVTTETHP SLSWKTCTGT GGTSCCTTKAG KITLDANWRW THVTGYTNC YDGNSWNTTA CPDGATCTKN CAVDGADYSG TYGITTSSNS LSIKFVTKGS NSANIGSRTY LMESDTKYQM FNLIGQEFTF DVDVSKLPCG LNGALYFVEM AADGGIGKGN NKAGAKYGTG YCDSQCPHDI KFINGKANVE GWNPSDADPN AGSGKIGACC PEMDIWEANS ISTAYTPHPC KGTGLQECTD DVSCGDGSNR YSGLCDKDGC DENSYRMGVK DFYGPGATLD TTKKMTVVTQ FLGSGSTLSE IKRFYVQNGK VFKNSDSAIE GVTGNSITES FCAAQKTAPG DTNSFKTLGG LNEMGASLAR GHVLVMSLWD DHAVNMLWLD STYPNSTKL GAQRGTCAID SGKPEDVEKN HPDATVVFSD IKFGPIGSTF QQPS |
| SEQ ID NO: 26 | MVDIQIATFL LLGVVGVAAQ QVGTYIPENH PLLATQSCTA SGGCTTSSSK IVLDANRRWI HSTLGTTSCL TANGWDPTLC PDGITCANYC ALDGVSYSST YGITTSGSAL RLQFVTGTNI GSRVFLMADD THYRTFQLLN QELAFDVDVS KLPCGLNGAL YFVAMDADGG KSKYPGNRAG AKYGTGYCDS QCPRDVQFIN GQANVGGWNA TSATTGTGSY GSCCTELDIW EANSNAAALT PHTCTNNAQT RCSGSNCTSN TGFCDADGCD FNSFRLGNTT FLGAGMSVDT TKTFTVVTQF ITSDNTSTGN LTEIRRFYVQ NGNVIPNSVV NVTGIGAVNS ITDPFCSQQK KAFIETNYFA QHGGLAQLGQ ALRTGMVLAF SISDDPANHM LWLDSNFPPS ANPAVPGVAR GMCSITSGNP ADVGILNPSP YVSFLNIKFG SIGTTFRPA |
| SEQ ID NO: 26 (cont) | MHQRALLFSA LAVAANAQQV GTQTPETHPP LTWQKCTAAG SCSQQSGSVV IDANWRWLHS TKDTNCYTG NTWNTELCPD NESCAQNCAL DGADYAGTYG VTTSGSELKL SFVTGANVGS RLYLMQDDET YQHFNLLNHE FTFDVDVSNL PCGLNGALYF VAMDADGGMS KYPSNKAGAK YGTGYCDSQC PRDLKFINGM ANVEGWEPSS SDKNAGVGGH GSCCPEMDIW EANSISTAVT PHCDDVSQT MCSGDACGGT YSESRYAGTC DPDGCDFNPF RMGNESFYGP GKIVDTKSKM TVVTQFITAD GTDSGALSEI KRLYVQNGKV IANSVSNVAG VSGNSITSDF CTAQKKAFGD EDIFAKHGGL SGMGKALSEM VLIMSIWDDH HSSMMWLDST YPTDADPSKP GVARGTCEHG AGDPENVESQ HPDASVTFSN IKFGPIGSTY EG |
| SEQ ID NO: 27 | MFRTATLLAF TMAANVFGQQ VGTNTAENHR TLTSQKCTKS GGCSNLNTKI VLDANWRWLH STSGYTNCYT GNQWDATLCP DGKTCAANCA LDGADYTGTY GITASGSSLK LQFVTGSNVG SRVYLMADDT HYQMFQLLNQ EFTFDVDMSN LPCGLNGALY EFTFDVDMSN LPCGLNGALY LSAMDADGM AKYPTNKAGA KYGTGYCDSQ CPRDIKFING EANVEGWNAT TCCTEMDIWE ANNDAAAYTP HPCTTNAQTR CSGSDCTRDT GLCDADGCDF NSFRMGDQTF LGKGLTVDTS KPFTVVTQFI TNDGTSAGTL TEIRRLYVQN GKVIQNSSVK TCATTSGVPA QIEAQSPNAY VVFSNIKFGD AFGDTNYFAQ HGGLKQVGEA LRTGMVLALS IWDDYAANML WLDSNYPTNK DPSTPGVARG IGYTGSTTCA SPYTCHVLNP YYSQCY LNTTYTGTVS SSSVSSSHSS TSTSSSHSSS STPPTQPTGV TVPQWGQCGG |
| SEQ ID NO: 28 | MYQRALLFSF FLAAARAHEA GTVTAENHPS LTWQQCSSSG SCTTQNGKVV IDANWRWVHT TSGYTNCYTG NTWDTSICPD DVTCAQNCAL DGADYSGTYG VTTSGNALRL NFVTQSSGKN IGSRLYLLQD DTTYQIFKLL GQEFTFDVDV SNLPCGLNGA LYFVAMDADG NLSKYPGNKA GAKYGTGYCD SQCPRDLKFI NGQANVEGWQ PSANDPNAGV GHHGSSCAEM DWEANSIST AVTPHPCDTP GQTMCQGDDC GGTYSSTRYA GTCDPDGCDF NPYQPGNHSF YGPGKIVDTS SKFTVVTQFI TDDGTPSGTL LDSTYPTDAD PDTPGVARGT TEIKRFYVQN GKVIPQSEST ISGVTGNSIT TEYCTAQKAA FGDNTGFFTH GGLQKISQAL AQGMVLVMSL WDDHAAANMLW CPTTSGVPAD VESQNPNSVY IYSNIKVGPI NSTFTAN |
| SEQ ID NO: 29 | MQIKSYIQYL AAALPLLSSV AAQQAGTITA ENHPRMTWKR CSGPGNCQTV QGEVVIDANW RWLHNNGQNC YEGNKWTSQC SSATDCAQRC ALDGANYQST TYGASTSGDSL TLKFVTKHEY GTNIGSRFYL MANQNKYQMF TLMNNEFAFD VDLSKVECGI YAYAFTPHAC GSKNRYHICE EDGGMASYPS NRAGAKYGTG YCDAQCARDL KFIGGKANIE GWRPSTNDPN AGVGPMGACC AEIDVWESNA YAYAFTPHAC GSKNRYHICE NSADITPELC DAQPFRVFDDR TNNCGGTYSD DRFAGYCDAN GCDYNPYRMG NKDFYGKGKT VDTINRKFTVV SRFERNRLSQ FFVQDGRKIE VPPPTWPGLP NSADITPELC DAQPFRVFDDR RFGPIGSTVN V NRFAETGGFD ALNEALTIPM VLVMSIWDDH HSNMLWLDSS YPPEKAGLPG GDRGPCPTTS GVPAEVEAQY PDAQVVWSNI |
| SEQ ID NO: 30 | MYRKLAVISA FLATARAQSA CTLQSETHPP LTWQQCSSGG VGARLYLMAS DTTYQEFTLL GNEFSFDVDV SQLPCGLNGA LYFVSMDADG NTWSSTLCPD NETCAKNCCL DGAAYASTYG VTTSGNSLSI GFVTGSAQKN NGQANVEGWE PSSNNANTGI GGHGSSCCSEM DIWEANSISE ALTPHPCTTV GQEICEGDGC GVSKYPTNTA GTYSDNRYG GTCDPDGCDW DPYRLGNTSF TTKKLTVVTQ TTKKLTVVTQ FETSGAINRY VQNGVTFQQ PNAELGSYSG NGLNDDYCTA EEAEFGGSSF SDKGGLTQFK KATSGMVLV MSLWDDYYAN TTGSSPGPTQ SHYGQCGGIG YSGPTVCASG TTCQVLNPYY SQCL GPIGSTGDPS GGNPPGGNP GTTTRRPAT |
| SEQ ID NO: 31 | MYQRALLFSF FLAAARAQQA GTVTAENHPS LTWQQCSSGG SCTTQNGKVV IDANWRWVHT TSGYTNCYTG NTWDTSICPD DVTCAQNCAL DGADYSGTYG VTTSGNALRL NFVTQSSGKN IGSRLYLLQD DTTYQIFKLL GQEFTFDVDV SNLPCGLNGA LYFVAMDADG GLSKYPGNKA GAKYGTGYCD SQCPRDLKFI NGQANVEGWQ PSANDPNAGV GHHGSSCCAEM DWEANSIST AVTPHPCDTP GQTMCQGDDC GGTYSSTRYA |

TABLE 7-continued

| SEQ ID NO. | Amino acid sequence | | | | | | |
|---|---|---|---|---|---|---|---|
| | GTCDPDGCDF | NPYRQGNHSF | YGPGQIVDTS | SKFTVVTQPI | TDDGTPSGTL | TEIKRPYVQN | GKVIPQSEST |
| | ISGVTGNSIT | TEYCTAQKAA | FGDNTGFFTH | GGLQKISQAL | | | |
| | AQGMVLVMSL | WDDHAANMLW | LDSTYPTDAD | CPTTSGVPAD | VESQYPNSYV | IYSNIKVGPI | NSTFTAN |
| SEQ ID NO: 32 | MIRKITLAA | LVGVVRGQAA | CSLITAETHPS | LTWQKCSSGG | LTWQKCAAGG | IDANWRTHT | TSGYTNCYTG | NKMDTSICST | NADCASKCCV |
| | DGANYQGTYG | ASTSGNALSL | QYVTQSSGKN | VGSRLYLLES | GNEFTFDVDA | SKLGCGLNGA | VYFVSMDADG | GQSKYSGNKA |
| | GAKYGTGYCD | SQCPRDLKYI | NGAANVEGWQ | PSSGDANSGV | DIWEANSIST | AYTPHPCSNN | AQHSCKGDDC | GGTYSSVRYA |
| | GDCDPDGCDF | NSYRQGNRTF | YGPGSNFNVD | SSKKVTVVTQ | FISSGGQLTD | IKRFYVQNGK | VIPNSQSTIT | GVTGNSVTQD | YCDKQKTAFG |
| | DQNVFNQRGG | LRQMGDALAK | GMVLVMSVWD | DHHSQMLWLD | STYPTTSTAP | GAARGSCSTS | SGKPSDVQSQ | TPGATVVYSN | IKFGPIGSTF | KSS |
| SEQ ID NO: 33 | MLRRALLLSS | SAILAVKAQQ | AGTATAENHP | PLTWQECTAP | GSCTTQNGAV | VLDANWRWVH | DVNGYTNCYT | GNTWDPTYCP | DDETCAQNCA |
| | LDGADYEGTY | GVTSSGSSLK | LNFVTGSNVG | SRLYLLQDDS | TYQIFKLLNR | EFSFPDVDVSN | LPCGLNGALY | FVAMDADGGV | SKYPNNKAGA |
| | KYGTGYCDSQ | CPRDLKFIDG | EANVEGWQPS | SNNANTGIGD | HGSCCAEMDV | WEANSLSNAV | TPHPCDTPGQ | TMCSGDDCGG | TYSNDRYAGT |
| | CDPDGCDFNP | YRMGNTSFYG | PGKIDTTTKP | FTVVTQFLTD | DGTDTGTLSE | IKRFYIQNSN | VIPQPNSDIS | GVTGNSITTE | FCTAQKQAFG |
| | DTDDFSQHGG | LAKMGAAMQQ | GMVLVMSLWD | DYAAQMLWLD | SDYPTDADPT | TPGIARGTCP | TDSGVPSDVE | SQSPNSVYTY | SNIKFGPINS | TFTAS |
| SEQ ID NO: 34 | MHQRALLFSA | FWTAVGAQQA | GTLITAETHPS | LTWQKCAAGG | TCTEBQKGSVV | LDSNWRWLHS | VDGSTNCYTG | NTWDATLCPD | NESCASNCAL |
| | DGADYEGTYG | VTTSGDALTL | QFVTGANIGS | RLYLMADDDE | SYQTFNLLNN | EFTFDVDASK | LPCGLNGALY | FVSMDADGGV | AKYSTNKAGA |
| | KYGTGYCDSQ | CPRDLKFING | QVRKGWEPSD | SDKNAGVGGH | GSCCPQMDIW | EANSISTAYT | PHPCDDTAQT | MCEGDTCGGT | YSSERYAGTC |
| | DPDGCDFNAY | RMGNESFYGP | SKLVDSSSPV | TVVTQFITAD | GTDSGALSEI | KRFYVQGGKV | IANAASNVDG | VTGNSITADF | CTAQKFAFGD |
| | DDIFAQHGGL | QGMGNALSSM | VLTLSIWDDH | HSSMMWLDSS | YPEDADATAP | GVARGTCEPH | AGDPEKVESQ | SGSATVTYSN | IKYGPIGSTF | DAPA |
| SEQ ID NO: 35 | MASTLSFKIY | KNALLLAAFL | GAAQAQQVGT | STAEVHPSLT | WQKCTAGGSC | TSQSGKVID | SNWRWVHNTG | GYTNCYTGND | WDRTLCPDDV |
| | TCATNCALDG | ADYKGTYGVT | ASGSSLRLNF | VTQASQKNIG | SRLYLMADDS | KYEMFQLLNQ | EFTFDVDVSN | LPCGLNGALY | FVAMDEDGGM |
| | ARYPTNKAGA | KYGTGYCDAQ | CPRDLKFING | PSKIVDTESP | QANVEGWEPS | SSDVNGGTGN | YGSCCAEMDI | WEANSISTAF | TPHPCDDPAQ | TRCTGDSCGG |
| | TYSSDRYGGT | CDPDGCDFNP | YRMGNQSFYG | MAGMGAGLAE | GMVLVMSLWD | DHAANMLWLD | STYPTSASST | TPGAARGSCD | IKRFYVQNGK | VIPQSVSTIS | AVTGNSITDS |
| | FCSAQKTAFK | DTDVFAKHGG | TFGSTDSGSG | TTTKVTTTI | ATKTTTTTGP | STTGAAHYAQ | CGGQNWTGPT | TCASPYTCQR | ISSGEPSDVE | ANHSNAYVYY |
| | SNIKVGPLGS | | | | | QDYYSQCL | | | |
| SEQ ID NO: 36 | MVSAKFAALA | ALVASASAQQ | VCSLTPESHP | PLTWQRCSAG | GSCTNVAGSV | TLDSNWRWTH | TLQGSTNCYS | GNEWDTSICT | TGTKCAQNCC |
| | VEGAEYAATY | GITTSCNQLN | LKFVTEGKYS | TNVGSRTYLM | ENATKYQGFN | LLGNEFTFDV | DVSNIGCGLN | GALYFVSMDL | DGGLAKYSGN |
| | KAGAKYGTGY | CDAQCPRDIK | FINGEANIEG | WNPSTNDVNA | GAGRYGTCCS | EMDIWEANNM | ATAYTPHSCT | ILDQSRCEGE | SCCGTYSSDR |
| | YGGVCDPDGC | DFNSYRMGNK | EFYGKGKTVD | TTKKMTVVTQ | FLKNAAGELS | EIKRFYVQNG | VVIPNSVSSI | PGVPNQNSIT | QDWCDAQKIA |
| | FGDPDDNTAK | GGLRQMGLAL | DKPMVLVMSI | WNDHAAHMLW | LDSTYPVDAA | GRPGAERGAC | PTTSGVPSEV | EAEAPNSNVA | FSNIKFGPIG | STFNSGSTNP | NPISSSTATT |
| | PTSTRVSSTS | TAAQTPTSAP | GGTYPRWGQC | GGGQYTGPTQ | CVAPYTCVVS | NQWYSQCL | | | |
| SEQ ID NO: 37 | MFPYIALVSF | SFLSVVLAQQ | VGTLTAETHP | QLTVQQCTRG | GSCTTQQRSV | VLDGNWRWLH | STSGSNNCYT | GNTWDTSLCP | DAATCSRNCA |
| | LDGADYSGTY | GITSSGNALT | LKFVTHGPYS | TNIGSRVILL | ADDSHYQMFN | LKNKEFTFDV | DVSQLPCGLN | GALYFSQMDA | DGGTGRFPNN |
| | KAGAKYGTGY | CDSQCPRDLK | FINGEANVQG | WQPSNEVNGA | GKGQYGSCCA | EMDIWEANSM | ASAYTPHPCT | VTTPTRCQGN | DCGDGDNRYG |
| | GVCDKDGCDF | NSFRMGDKNF | LGPGKTVNTN | SKFTVVTQFL | TSDNTTSGTL | SEIRRLYVQN | GRVIQNSKVN | IPGMASTLDS | ITESFCSTQK |
| | TVFGDTNSFA | SKGGLRAMGN | AFDKGMVLVL | SIWDDHREAKM | LWLDSNYPLD | KSASAPGVAR | GTCATTSGEP | KDVESQSPNA | QVIFSNIKYG | DIGSTYSN |
| SEQ ID NO: 38 | MYRAIATASA | LIAAVRAQQV | CSLTQESKPS | LNWSKCTSSG | CSNVKGSVTI | DANWRWTHQV | SGSTNCYTGN | KWDTSVCTSG | KVCCAERCCLD |
| | GADYASTYGI | TSSGDQLSLS | FVTKGPYSTN | IGSRTYLMED | ENTYQMFQLL | GNLGTCCPEM | SNIGCGLNGA | LYFVSMDADG | GRAKYPGNKA |
| | GAKYGTGYCD | AQCPRDVKFI | NGQANSDGWQ | PSDSDVNGGI | FHKGSNGRLS | DIWEANSIST | AYTPHPCTKL | TQHSCTGDSC | GGTYSNDRYG |
| | GTCDDADGCDF | NSYRQGNKTF | YGPGSGFNVD | TTKKVTVVTQ | EITRLYVQNG | KVIANSESKI | AGVPGNSLTA | DPCTKQKKVF | NIKFGPIGST |
| | NDPDDFTKKG | AWSGMSDALE | APNMLVMSLW | HDHHSNMLWL | DSTYPDSTK | LGSQRGSCST | SSGVPADLEK | NVPNSKVAFS | |
| | YKSDGTTPTN | PTNPSEPSNT | ANPNPGTVDQ | WGQCGGSNVS | GPTACKSGFT | CKKINDFYSQ | CQ | | |
| SEQ ID NO: 39 | MYSAAVLATF | SFLLGAGAQQ | VGTLKTESHP | PLTIQKCAAG | GTCTDEADSV | VLDANWRWLH | STSGSTNCYT | GNTWDTTLCP | DAATCANCA |
| | FDGADYEGTY | GITSSGDSLK | LSFVTGSNVG | SRTYLMDSET | TYKEFALLGN | EFTFTVDVSK | LPCGLNGALY | FVPMDADGGM | SKYPTNKAGA |
| | KYGTGYCDAQ | CPQDMKFVSG | GANNEGWVPD | SNSANSGTGN | IGSCCSEFDV | WEANSMSQAL | TPHTCTVDGQ | TACTGDDCAG | NTVCDADGC |

TABLE 7-continued

| SEQ ID NO. | Amino acid sequence |
|---|---|
| SEQ ID NO: 40 | MFRAAALLAF TCLAMVSGQQ AGTNTAENHP QLQSQQCTTS GGCKPLSTKV VLDSNRWVH STSGYTNCYT GNEWDTSLCP DGKTCAANCA LDGADYSGTY GITSTGTALT LKFVTGSNVG SRVYLMADDT HYQLLKLLNQ EFTFPDVDMSN LPCGLNGALY LSAMDADGGM SKYPGNKAGA KYGTGYCDSQ CPKDIKFING EANVGNWTET GSNTGTGSYG TCCSEMDIWE ANNDAAAFTP HPCTTTGQTR CSGDDCARNT GLCDGDGCDF NSFRMGDKTF LGKGMTVDTS KPFTVVTQFL TNDNTSTGTL SEIRRIYIQN GKVIQNSVAN IPGVDPVNSI TDNFCAQQKT AFGDTNWFAQ KGGLKQMGEA LGNGMVLALS IWDDHAANML WLDSDYPTDK DPSAPGVARG TCATTSGVPS DVESQVPNSQ VVFSNIKFGD IGSTFSGTSS PNPPGGSTTS SPVTTSPTPP PTGPTVPQWG QCGGIGYSGS TTCASPYTCH VLNPYYSQCY |
| SEQ ID NO: 41 | MYRKLAVISA FLATARAQSA CTLQSETHPP LTWQKCSSGG TCTQTQTGSVV IDANWRWTHA TNSSTNCYDG NTWSSTLCPD NETCAKNCCL DGAAYASTYG VTTSGNSLSI GFVTQSAQKN VGARLYLMAS DTTYQEFTLL GNEFSFDVDV SQLPCGLNGA LYFVSMDADG GVSKYPTNTA GAKYGTGYCD SQCPRDLKFI NGQANVEGWE PSSNNANTGI GGHGSCCSEM DIWEANSISE ALTPHPCTTV GQEICEGDGC GGTYSDNRYG GTCDPDGCDW NPYRLGNTSF YGPGSSFTLD TTKKLTVVTQ FETSGAINRY YVQNGVTFQQ PNAELGSYSG NELNDDYCTA EEAEFGGSSF SDKGGLTQFK KATSCGMVLY MSLWDDYYAN MLWLDSTYPT NETSSTPGAV RGSCSTSSGV PAQVESQSPN AKVTFSNIKF GPIGSTGNPS GGNPPGGNRG TTTTRRPATT TGSSPGPTQS HYGQCGGIGY SGPTVCASGT TCQVLNPYYS QCL |
| SEQ ID NO: 42 | MPSTYDIYKK LLLLASFLSA SQAQQVGTSK AEVHPSLTWQ TCTSGGSCTT VNGKVVVDAN WRWVHNVDGY NNCYTGNTWD TTLCPDDETC ASNCALEGAD YSGTYGVTTS GNSLRLNFVT QASQKNIGSR LYLMEDDSTY KMFKLLNQEF TFDVDVSNLP CGLNGAVLFV SMDADGGMAK YPANKAGAKY GTGYCDSQCP RDLKFINGMA NVEGWEPSAN NANAGTGNHG SCCAEMDIWE ANSISTAYTP HPCDTPGQVM CTGDSCGGTY SSDRYGGTCD PDGCDFNSYR QGNKTFYGPG MVTDTKSKIT VVTQFLTNDG TASGTLSEIK RFYVQNGKVI PNSESTWSGV SGNSITTAYC NAQKTLFGDT DVFTKHGGME GMGAALAEGM VLVLSLWDDH NSNMLWLDSN YPTDKPSTTP GVARGSCDIS SGDPKDVEAN DANAYVVYSN IKVGPIGSTF SGSTGGGSSS STTATSKTTT TSAATKTTTT TKTTTTTSAS STSTGGAQHW AQCGGIGWTG PTTCVAPYTC QKQNDYYSQC L |
| SEQ ID NO: 43 | MISKVLAFTS LLAAARAQQA GTLTTETHPP LSVSQCTASG CTTSAQSIVV DANWRWLHST TGSTNCYTGN VSNLLPCGLNG ALYFAAMDAD ATCAANCALD GADYSGVYGI TTSGNSIKLN FVTKGANTNV GSRTYLMAAG STTQYQMLKL LNQEFTFDVD VSNLPCGLNG AAYTPHPCSV DTQRCTGTD GGLSRFPTNK AGAKYGTGYC DAQCPQDIKF INGVANSVGW TPSSNDVNAG AGQYGSCCSE MDIWEANKIS IRRFYVQNGV VPNSQSTIA GVPGNSITDS CGIGARYSSL CDADGCDFNS NSFRMGDKSF AGLTVNTNKV FTVVTQFIIN DDTASGTLWE APYPATKSPS APGVTRGSCS ATSGNPVDVE ANSPGSSVTF FCAAQKTAFG DTNEFATKGG LATMSKALAK GMVLVMSIWD DHTANMLWLD GVAKYAQCGG SGYSGATACV SGSTCVALNP YYSQCQ SNIKWGPINS TYTGSGAAPS VPGTTTVSSA PASTATSGAG |
| SEQ ID NO: 44 | MFPAATLFAF SLFAAVYGQQ VGTQLAETHP RLTWQKCTRS GGCQTQSNGA IVLDANWRWV HNVGGYTNCY TGNTWNTSLC PDGATCAKNC ALDGANYQST YGITTSGNAL TLKFVTQSEQ KNIGSRVILL ESDTKIYQLFN PLNQEFTFDV DVSQLPCGLN GAVFSAMDA DGGMSKFPNN AAGAKYGTGY CDSQCPRDIK FINGEANVQG WQPSPNDTNA GTGNYGACCN EMDVWEANSI STAYTPHPCT QQGLVRCSGT ACGGGSNRYG SICDPDGCDF NSFRMGDKSF YGPGLTVNTQ QKFTVVTQFL TNNNSSSGTL REIRRLYVQN GRVIQNSKVN IPGMPSTMDS VTTEFCNAQK TAPNDTPSFQ QKGGWANMSE ALRRGMVLVL SIWDDHAANM LWLDSNYPTD RPASQPGVAR GTCPTSSGKP SDVENSTANS QVIYSNIKFG DIGSTYSA |
| SEQ ID NO: 45 | MKGSISYQIY KGALLLSALL NSVSAQQVGT LTAETHPALT WSKCTAGKCS QVSGSVVIDA NWPXVHSTSG STNCYTGNTW DATLCPDDVT CAANCAVDGA RRQHLRVTTS GNSLRINFVT TASQKNIGSR LYLLENDTTY QKFNLLNQEF TFDVDVSNLP CGLNGALYFV DMDADGGMAK CTGQRCGGTY YPTNKAGAKY GTGYCDSQCP RDLKFINGQA NVDGWTPSKN DVNSGIGNHG SCCAEMDIWE ANSISNAVTP HPCDTPSQVM GNPQSTIVGV SGNSITDSWC STDRYGGTCD PDGCDFNPYR MGVTNFYGPG ETIDTKSPFT VVTQFLTNDG ASDMLWLDST YPTNATSTTP GAKRGTCDIS RRPNTVESTY PNAYVIYSNI NAQKSAFGDT NEFSKHGGMA GMGAGLADGM VLVMSLWDDH VLVMSLWDDH VLVMSLWDDH TTTTSSGSSG TGARDMAQCG GNGWTGPTTC VSPYTCTKQN DWYSQCL KTGPLNSTFT GGTTSSSSTT TTTSKSTSTS SSSKTTTTVT |
| SEQ ID NO: 46 | MFRTAALTAF TLAAVLGQQ VGTLTAENHP ALSIQQCTAS GCTTQQKSVV LDSNWRWTHS LPVHTNCYTG NAWDASLCPD PTTCATNCAI DGADYSGTYG ITTSGNALTL RFVTNGPYSK NIGSRVLLD DADHYKMFDL KNQEFTFDVD MSGLPCGLNG ALYFSEMPAD GGKAAHTSNK AGAKYGTGYC DAQCPHDIKW INGEANILDW SASATDANAG NGRYGACCAE MDIWEANSEA TAYTPHVCRD EGLYRCSGTE CGDGDNRYGG VCDKDGCDFN SYRMGDKNFL GRGKTIDTTK KITVVTQFIT DDNTSSGNLV EIRRVVVQDG VTYQNSFSTF PSLSQYNSIS DDFCVAQKTL |

TABLE 7-continued

| SEQ ID NO. | Amino acid sequence |
|---|---|
| SEQ ID NO: 47 | FGDNQYYNTH GGTEKMGDAM ANGMVLIMSL WSDHAAHMLW LDSDYPLDKS PSEPGVSRGA CATTTGDPDD VVANHPNASV TFSNIKYGPI GSTYGGSTPP VSSGNTSAPP VTSTTSSGPT TPTGPTGTVP KWGQCGNGY SGPTTCVAGS TCTYSNDWYS QCL |
| SEQ ID NO: 48 | MYQRALLFSA LLSVSRAQQA GTAQEEVHPS LTWQRCEASG SCTEVAGSVV LDSNWRTHS VDGYTNCYTG NEWDATLCPD NESCAQNCAV DGADYEATYG ITSNGDSLTL KFVTGSNVGS RVLMEDDET YQMFDLLNNE FTFDVDVSNL PCGLNGALYF TSMDADGGLS KYFGNTAGAK YGTGYCDSQC PRDIKFINGL GNVEGWEPSD SDANAGVGM GTCCPEMDIW EANSISTAYT PHPCDSVEQT VQNGEVIPNS MCEGDSCGGT YSDDRYGGTC DPDGCDFNSY RMGNTSFYGP GAIIDTSSKF TVVTQFIADG GSLSEIRKFY VQNGEVIPNS ESNISGVEGN SITSEFCTAQ KTAFGDEDIF AQHGGLSAMG DAASAMVLIL SIWDDHHSSM MWLDSSYPTD ADPSQPGVAR GTCEQGAGDP DVVESEHADA SVTFSNIKFG PIGSTF |
| SEQ ID NO: 49 | MYRAIATASA LIAAVRAQQV CSLITTETKPA LTWSKCTSSG CSNVQGSVTI DANWRTHQV SGSTNCHTGN KWDTSVCTSG KVCAEKCCVD GADYASTYGI TSSGNQLSLS FVTKGSYGTN IGSRTYLMED ENTYQMFQLL GNEFTFDVDV SNICGLNGA LYFVSMDADG GRAKYPGNKA GAKYGTGYCD AQCPRDVKFI NGQANSDGWE PSKSDVNGGI GNLGTCCPEM DIWEANSIST AYTPHPCTKL TQHACTGDSC GGTYSNDRYG GTCDADGCDR NAYRGDWTKT YGPGSPHFYD TTKKLYVTNG TTRLYVQNG KVIANSESKI AGNPGSSLTS DFCTTQKKVF GDIDDFAKKG AWNGMSDALE APMVLVMSLW HDHISNMLWL DSTYPTDSTA LGSQRGSCST SSGVPADLEK NVPNSKVAPS NIKFGPIGST YNKEGTQPQP TNPTNPNPTN PTNPGTVDQW GQCGGTNYSG PTACKSPFTC KKINDFYSQC Q |
| SEQ ID NO: 50 | MFRTAALTAF TLAAVVLGQQ VGTLAAEHNP ALSIQQCTAS GCTTQQKSVV LDSNWRTHS NAWDSSLCPN PTTCATNCAI DGADYSGTYG ITTSGNSLTL RFVTNGQYSE NIGSRVYLLD DADHYKLFNL KNQEFTFDVD MSGLPCGLNG ALYPSEMAAD GGKAAHTGNN AGAKYGTGYC DAQCPHDIKW INGERANILDW SGSATDPNAG NGRYGACCAE MDIWEANSEA TAYTPHVCRD EGLYRCSGTE CDGDDNRYGG VCDKDGCDFN SYRMGDKNFL GRGKTIDTTK KITVVTQFIT DDNTPTGNLV EIRRVVQDG VTYQNSFSTF PSLSQYNSIS DDFCVAQKTL FGDNQYYNTH GGTEKMGDSL ANGMVLIMSL WSDHAAHMLW LDSDYPLDKS PSEPGVSRGA CATTTGDPDD VVANHPNASV TFSNIKYGPI VTSTTSSGPT TPTGPTGTVP KWGQCGGIGY SGPTSCVAGS TCTYSNEWYS QCL GSTYGGSTPP VSSGNTSVPP |
| SEQ ID NO: 51 | MYQKLALISA FLATARAQSA CTLQAETHPP LTWQKCSSGG TCTQTGSVV IDANWRTHA TNSSTNCYDG NTWSSTLCPD NETCAKNCCL DGAAYASTYG VTTSADSLSI GFVTGSAQKN VGARLYLMAS DTTYQEFTLL GGHGSCCSEM GNEFSFDVDV SQLPCGLNGA LYFVSMDADG GVTKYPTNTA GAKYGTGYCD SQCPRDLKFI NGQANVEGWT PSSNNANTGI TTKKLTVVTQ FETSGAINRY DIWEANSISE ALTPHPCTTV GQEICEGDSC GGTYSGDRYG GTCDPDGCDW NPYRLGNTSF YGPGSSFTLD TKKLTVVTQ FETSGAINRY VYQNGVTFQQ PNAELGDYSG NSLDDDYCAA EEAEFGGSSF SDKGGLTQFK KATSGMVLV MSLWDDYYAN MLWLDSTYPT RGSSSTSSGV PAQLESNSPN AKVVYSNIKF GPIGSTGNPS GGNPPGGNPP GTTTPRPATS TGSSPGPTQI HYGQCGGIGY TCQVLNPYYS QCL |
| SEQ ID NO: 52 | MTWQSCTAKG SCTNKNGKIV IDANWRWLHK KEGYDNCYTG NEWDATACPD NKACAANCAV DGADYSGTYG ITAGSNSLKL KFITKGSYST NIGSRTYLMK DDTTYEMFKF TGNQEFTFDV DVSNLPCGFN GALYFVSMDA DGGLKKYSTN KAGAKYGTGY CDAQCPRDLK FINGEGNVEG WKPSSNDANA GVGGHGSCCA EMDIWEANSV STAVTPHSCS TIEQSRCDGD GCGGTYSADR YAGVCDPDGC DFNSYRMGVK DFYGKGKTVD TSKKFTVVTQ FIGTGDAMEI KRFYVQNGT IAQPASAVFG VEGNSITTKF CDQQKAVFGD TYTFKDKGGM ANMAKALANG MVLVMSLWDD HYSNMLWLDS TYPTDKNPDT DLGTGRGECE TSSGVPADVE SQHADATVVY SNIKFGPLNS TFG |
| SEQ ID NO: 53 | MASAISFQVY RSALILSAFL PSITQAQQIG TYTTETHPSM TWETCTSGGS CATNQGSVVM DANWRWHQV GSTTNCYTGN TWDTSICDTD ETCATRECAVD GADYESTYGV TTSGSQIRLN FVTGNSNGAN VGSRLYMMAD NTHYQMFKLL NQEFTFDVDV SNLPCGLNGA LYFVTMDEDG GVSKYPNNKA GAQYGVGYCD GTCDPDGCDF NPYRMGNTTF YGPGKTIDTN QGQANVEGWT PSSNNENTGL GNYGSCCAEL DIWESNSISQ ALTPHPCDTA TNTMCTGDAC GGTYSSDRYA DYCTAENTV FDGPGTFAKH GGFSAMSEAM STGMVLVMSL WDDYYADMLW LDSTYPTNAS SSTPGAVRGS CSTDSGVPAT IESESPDSYV TYSNIKVGPI GSSGSGSGS ASTSTSTKI TAATSTSTAV AQHYSQCGGQ DWTGPTTCVS PYTCQVQNAY YSQCL |
| SEQ ID NO: 54 | MKAYFEYLVA ALPLLGLATA QQVGKQTTET HPKLSWKKCT GKANCNTVNA EVVIDSNWRW LHDSSGKNCY DGNKWTSACS SATDCASKCQ LDGANYGTTY GASTSGDALT LKFVTKHEYG TNIGSRFYLM NGASKYQMFT LMNNEFAFDV DLSTVECGLN AALYFVAMEE DGGMASYSSN KAGAKYGTGY CDAQCARDLK FVGGKANIES WTPSTNDANA GVGPYGGCCA EIDVWESNAH SFAFTPHACK TNKYHVCERD NCCGTYSEDR FAGLCDANGC DYNPYRMGNT DFYGKGKTVD TSKKFTVVSR FEENKLTQFF VQNGQKIEIP GPKWDGIPSD NANITPEFCS AQFQAFGDRD RFAEVGFAQ LNSALRMPMV LVMSIWDDHY ANMLWLDSVY PPEKEGGPGA ARGDCPQSSG VPAEVESQYA NSKVVYSNIR FGPVGSTVNV |
| SEQ ID NO: 55 | MFSKFALTGS LLAGAVNAQG VGTQQTETHP QMTWQSCTSP SSCTTNQGEV VIDSNWRWVH DKDGVNCYT GNTWNTTLCP DDKTCAANCV LDGADYSTY GITTSGNALS LQFVTQSSGK NIGSRTYLME SSTKYHLFDL IGNEFAFDVD LSKLPCGLNG ALYFVTMDAD GGMAKYSTNT |

TABLE 7-continued

| SEQ ID NO. | Amino acid sequence |
|---|---|
| SEQ ID NO: 55 | AGAEYGTGYC DSQCPRDLKF INGQQNVEGW TPSTNDANAG VGGLGSCCSE MDVWEANSMD MAYTPHPCET AAQHSCNADE CGGTYSSSRY AGDCDPDGCD WNPFRMGNKD FYGSGDTVDI SQKFTVVTQF HGSGSSLTEI SQYYIQGGTK IQQPNSTWPT LTGYNSITDD FCKAQKVEFN DTDVFSEKGG LAQMGAGMAD GMVLVMSLWD DHYANMLWLD STYPVDADAS SPGKQRGTCA TTSGVPADVE SSDASATVIY SNIKFGPIGA TY |
| SEQ ID NO: 56 | MPPAAALLSF TLLAVASAQQ IGTNTAEVHP SLTVSQCTTS GGCTSSTQSI VLDANWRWLH STSGYTNCYT GNQWNSDLCP DPDTCATNCA LDGASYESTY GISTDGNAVT LNFVTQGSQT NVGSRVLLS DDTHYQTFSL LNKEFSFDVD ASNIGCGING AVYFVQMDAD GGLSKYSSNK AGAQYGTGYC DSQCPQDIKF INGRANLLDW NATSANSGTG SYGSCCPEMD IWEANKYAAA YTPHPCSVSG QTRCTGTSCG AGSERYDGYC DKDGCDFNSW RMGNETFLGP GMTIDTNKKF TIVTQFITDD NTANGTLSEI RRLYVQGGTV IQNSVANQPN IPKVNSITDS FCTAQKTEFG DQDYFGTIGG LSQMGKAMSD MVLVMSIWDD YDAEMLWLDS NYPTSGSAST PGISRGPCSA TSGLPATVES QQASASVTYS NIKWGDIGST YSGSGSGSS SSSSSAASA STSTHTSAAA TATSSAAAAT GSPVPAYGQC GGQSYTGSTT CASPYVCKVS NAYYSQCLPA |
| SEQ ID NO: 56 | MKRALCASLS LLAAAVAQQV GTNEPEVHPK MTWKKCSSGG SCSTVNGEVV IDGNWRWIHN IGGYENCYSG NKWTSVCSTN ADCATKCAME GAKYQETYGV STSGDALTLK FVQQNSSGKN VGSRMYLMNG ANKYQMFTLK NNEFAFDVDL SSVECGMNSA LYFVPMKEDG GMSTEPNNKA GAKYGTGYCD AQCARDLKFI GGKGNIEGWQ PSSTDSSAGI GAQGACCAEI DIWESNKNAF AFTPHPCENN EYHVCTEPNC GGTYADDRYG GGCDANGCDY NPYRMGNPDF YGPGKTIDTN RKFTVISRFE NNRNYQILMQ DGVAHRIPGP KFDGLEGETG ELNEQFCTDQ FTVFDERNRF NEVGGWSKLN AAYEIPMVLV MSIWSDHFAN MLWLDSTYPP EKAGQPGSAR GPCPADGGDP NGVVNQYPNA KVIWSNVRFG PIGSTYQVD |
| SEQ ID NO: 57 | MQLTKAGVFL GALMGGAAAQ QVGTQTAENH PKMTWKKCTG KASCTTVNGE VVIDANWRWL HDASSKNCYD GNRWTDSCRT ASDCAAKCSL EGADYAKTYG ASTSGDALSL KFVTRHDYGT NIGSRFYLMN GASKYQMFSL LGNEFAFDVD LSTIECGLNS ALYFVAMEED GGMKSYSSNK AGAKYGTGYC DAQCARDLKF VGGKANIEGW KPSSNDANAG VGPYGACCAE IDVWESNAHA FAFTPHPCTD NKYHVCQDSN CGGTYSDDRF AGKCDANGCD INPYRLGNTD FYGKGKTVDF SKKFTVVTRF ERDALTQFFV QNNKRIDMPS PALEGLPATG AITAEYCTNV FNVFGDRNRF DEVGGWSQLQ QALSLPMVLV MSIWDDHYSN MLWLDSVYPP DKEGSPGAAR GDCPQDSGVP SEVESQIPGA TVVWSNIRFG PVGSTVNV |
| SEQ ID NO: 58 | MYRIVATASA LIAAARAQQV CSLNTETKPA LTWSKCTSSG CSDVKGSVVI DANWRWTHQT SGIGCGLNGA PHFVSMDEDG KTCAEKCCLD GADYSGTYGI TSSGNQLSLG FVTNGPYSKN IGSRTYLMEN ENTYQMFQLL GNEFTFDVDV GNEFTFDVDV SGIGCGLNGA PHFVSMDEDG GKAKYSGNKA GAKYGTGYGI AQCPRDVKFI NGVANSEGWK PSDSDVNAGV GNLGTCCPEM DIWEANSIST AFTPHPCTKL TQHSCTGDSC GGTYSSDRYG GTCDADGCDF NAYRQGNKTF YGPGSNFNID TTKKMTVVTQ FHKGSNGRLS EITRLLYVQNG KVIANSESKI AGNPGSSLTS DFCSKQKSVF GDIDDFSKKG GWNGMSDALS APMVLVMSLW HDHHSNMLWL DSTYPTDSTK VGSQRGSCAT TSGKPSDLER DVPNSKVSFS NIKFGPIGST YKSDGTTPNP PASSSTTGSS TPTNPPAGSV DQWGQCGGQN YSGPTTCKSP FTCKKINDFY SQCQ |
| SEQ ID NO: 59 | MYQRALLFSA LATAVSAQQV GTQKAEVHPA LTWQKCTAAG SCTDQKGSVV IDANWRWLHS TEDTTNCYTG NEWNAEHLCPD NEACAKNCAL DGADYSGTYG VTADGSSLKL NFVTSANVGS RLYLMEDDET YQMFNLLNNE FTFDVDVSNL PCGLNGALYF VSMDADGGLS KYPGNKAGAK YGTGYCDSQC PRDLKFINGE ANVEGWKPSD NDKNAGVGGY GSCCPEMDIW EANSISTAYT PHPCDGMEQT RCDGNDCGGT YSSTRYAGTC DPDGCDFNSF RMGNEFYGP GGLVDTKSPI TVVTGPVAGI ASSMMWLDST YPVDADASTP GTDSGALKSPI RVVYVQGGKV IGNASNVAG VEGDSITSDF CTAQKKAFGD EDIFSKHGGL EGMGKALNKM ALIVSIWDDH ASSMMWLDST YPVDADASTP GVARGTCEHG LGDPETVESQ HPDASVTFSN IKFGPIGSTY KSV |
| SEQ ID NO: 60 | MSALNSFNMY KSALIIGSLL ATAGAQQIGT YTAETHPSLS WSTCKSGGSC TTNSGAITLD ANWRWHGVN TSTNCYTGNT WNTAICDTDA SCAQDCALDG ADYSGTYGIT TSGNSLRLNF VTGSNVGSRT YLMADNTHYQ IFDLLNQEFT FTVDVSNLPC GLNGALYFVT MDADGVSKY PNNKAGAQYG VGYCDSQCPR DLKFIAGQAN VEGWTPSTNN SNTGIGNHGS CCAELDIWEA NSISEALTPH PCDTPGLITVC TADDCGGTYS SNRYAGTCDP DGCDFNPYRL GVTDPFYGSGK TVDTTKPFTV VTQFVTDDGT LVMSLWDDYS VNMLWLDSTY PANETGPTGA ARGSCPTTSG GNVINSDFCA AELSAFGETA SFTNHGGLKN MGSALEAGMV LVMSLWDDYS VNMLWLDSTY PANETGPTGA ARGSCPTTSG QPSSKISGIS SSYVVFSDIK VGPFNSTFSG GTSTGGSTTT TASGTTSTKA STTSTSTST GTVAAHWGQ CGGQGWTGPT TCASGTTCTV VNPYYSQCL |
| SEQ ID NO: 61 | MRTAKFATLA ALVASAAAQQ ACSLTTERHP SLSWNKCTAG TLDSNWRWTH QVSGSTNCYT GNKWDTSICT QVSGSTVQASI DAKSCAQNCC VDGADYTSTY GITTNGDSLS LKFVTKGQHS TNVGSRTYLM DGEDKYQTFE LLGNEFTFDV DVSNIGCGLN GALYFVSMDA DGGLSRYPGN KAGAKYGTGY CDAQCPRDIK FINGEANIEG WTGSTNDPNA GAGRYGTCCS EMDIWEANNM ATAFTPHPCT IIGQSRCEGD SCGGTYSNER YAGVCDPDGC DFNSYRQGNK TFYGKGMTVD TTKKITVVTQ FLKDANGDLG EIKRFVQDG KPGAERGACP TTSGVPAEVE AEAPNSNVVF DWCDRQKVAF GDIDDNRKG GMKQMGKALA GPMVLVMSIW DDHASNMLWL DSTFPVDAAG GFTGPTQCEE PYICTKLNDW YSQCL SNIRFGPIGS TVAGLPGAGN GGNNGNPPP PTTTSSAPA TTTTASAGPK AGRWQQCGGI GFTGPTQCEE PYICTKLNDW YSQCL |

TABLE 7-continued

| SEQ ID NO. | Amino acid sequence |
|---|---|
| SEQ ID NO: 62 | MMYKKFAALA ALVAGASAQQ ACSLTAENHP SLTWKRCTSG GSCSTVNGAV TIDANWRWTH TVSGGSTNCYT GNQWDTSLCT DGKSCAQTCC VDGADYSSTY GITTSGDSLN LKFVTKHQYG TNVGSRVLM ENDTKYQMFE LLGNEFTFDV DVSNLGCGLN GALYFVSMDA DGMSKYSGN KAGAKYGTGY CDAQCPRDLK FINGEANVGN WTPSTNDANA GFGRYGSCCS EMDVWEANNM ATAFTPHPCT TVQGSRCEAD TCGGTYSSDR YAGVCDPDGC DFNAYRQGDK TFYGKGMTVD TNKKMTVVTQ FHKNSAGVLS EIKRFYVQDG KIIANAESKI PGNPGNSITQ EYCDAQKVAF SNTDDFNRKG GMAQMSKALA GPMVLVMSVW DDHYANMLWL DSTYPIDQAG APGAERGACP TTSGVPAEIE AQVPNSNVIF SNIRFGPIGS TVPGLDGSNP GNPTTTVVPP ASTSTSRPTS STSSPVSTPT GQPGGCTTQK WGQCGGIGYT GCTNCVAGTT CTQLNPWYSQ CL |
| SEQ ID NO: 63 | MASLSLSKIC RNALILSSVL STAGQQVGT YQTETHPSMT WQTCGNGGSC STNQGSVVLD ANWRWVHQTG SSSNCYTGNK WDTSYCSTND ACAQKCALDG ADYSNTYGIT TSGSEVRLNF VTSNSNGKNV GSRVYMMADD THYEVVKLLN QEFTFDVDVS KLPCGLNGAL YFVVMDADGG VSKYPNNKAG AKYGTGYCDS QCPRDLKFIQ GQANVEGHVS STNNANTGTG NHGSCCAELD IWESNSISQA LTPHPCDTPT NTLCTGDACG GTYSSDRYSG TCDPDGCDFN PYRVGNTTFY GPGKTIDTNK PITVVTQPFIT DDGTSSGTLS EIKRFYVQDG VTYPQPSADV YSNIKVGPIG STPKS GLAGMGEAMS TGMVLVMSLW DDYYANMLWL DSNYPTNEST SKPGVARGTC STSSGVPSEV |
| SEQ ID NO: 64 | MYRAIATASA LIAAVRAQQV CSLTPETKPA LSWSKCTSSG CSNVQGSVTI DANWRWTHQL SGSTNCYTGN KWDTSICTSG KVCAEKCCID GAEYASTYGI TSSGNQLSLS FVTKGAYGTN IGSRTYLMED ENTYQMFQLL GNEFTFDVDV SNIGCGLNGA LYFVSMDADG GKAKYPGNKA GAKYGTGYCD AQCPRDKFI NGQANSDGWQ PSKSDVNAGI GNMGTCCPEM DIWEANSIST AYTPHPCTKL TQHSCTGDSC GGTYSNDRYG GTCDADGCDF NAYRQCNKTF YGPGSGFNVD TTKKVTVVTQ FHKGSNGRLS BITRLYVQNG KVIANSESKI AGVPGSSLTP EPCTAQKKVF GDTDDFAKKG AWSGMSDALE APMVLVMSLW HDHHSNMLWL DSTYPTDSTK LGAQRGSCST SSGVPADLEK NVPNSKVAFS NIKFGPIGST YKEGVPEPTN PTNPTNPTNP TNPGTVDQWA QCCGGTNYSGP TACKSPFTCK KINDFYSQCQ |
| SEQ ID NO: 65 | MFPKSSLLVL SFLATAYAQQ VGTQTAEVHP SLNMARCTSS GCTNVAGSVT LDANWRWLHT TSGYTNCYTG NSWNTTLCPD GATCAQNCAL DGANYQSTCG ITTSGNALTL KFVTQGEQKN IGSRVYLMAS ESRYEMFGLL NKEFTFDVDV SNLPCGLNGA LYFSSMDADG GMAKNPGNKA GAKYGTGYCD SQCPRDIKFI NGEANVAGWN GSPNDTNAGT GNWGACCNEM DIWEANSISA AYTPHPCTVQ VVQNSKVNIP GLSRCSGTAC GTNDRYGTVC DPDGCDFNSY RMGDKTYYGP GGTGVDTRSK FTVVTQFLTN NNSSSGTLSE IRRLYVQNGR PSKPGIARGT CSTTSGKPTD GMSNTLDSIT TGFCDSQKTA FGDTRSPQNK GGMSAMGQAL GAGMVLVLSV WDDHAANMLW LDSNYPVDAD YPTTADASKP GVARGTCPNT SGVPKDVESQ VEQSAANSV TFSNIKFGDI GTTYTGGSVT TTPGNPGTTI STAPGAVQTK WGQCGGQWT QCCGGIYSG ATGCVSPYTC HVVNPYYSQC CI |
| SEQ ID NO: 66 | MFRKAALLAF SFLAIAHGQQ VGTNQAENHP SLPSQHCTAS GCTTSSTSVV LDANWRWVHT TTGYTNCYTG QTWDASICPD GVTCAKACAL DGADYSSTYG ITTSGNALTL QFVKGTNVGS RVLLQDASN YOLFKLINQE FTFDVDMSNL PCGLNGAVYL SQMDQDGGVS RFPTNTAGAK YGTGYCDSQC PRDIKFINGE ANVAGWTGSS SDPNSGTGNY GTCCSEMDIW SSGNLAEIRR FYVQDGKVIP NSKVNIAGCD AVNSITDKFC TQQKTAFGDT DGCDFNSFRM GDQTFLGKGL TVDTSRKFTI VTQFISDDGT YPTTADASKP GVARGTCPNT SGVPKDVESQ SGSATVTYSN IKWGDLNSTF NRFADQGGLK QMGAALKSGM VLALSLWDDH AANMLWLDSD APSSGSVAQW GQCCGIGYSG ATGCVSPYTC HVVNPYYSQC Y SGTASNPTGP SSSPSGPSSS SSSTAGSQPT |
| SEQ ID NO: 67 | TETHPRLTWK RCTSGGNCST VNGAVTIDAN WRWTHTVSGS TNCYTGNEWD FTFDVDVSNL GCGLNGALYF VSMDADGGMS KYSGNKAGAK YSSTYGITTS GDSLNLKFVT KHQHGTNVGS RVYLMENDTK YQMFELLGNE EANNMATAFT PHPCTIIGQS RVLQNGALY YSSERYAGVC DPDGCDFNAY RQGDKTFYGK ANIENWTPST NDANAGFGRY GSCCSEMDIW AGVLSEIKRF YVQDGKIIAN AESKIPGNPG NSITQEWCDA QKVAPGDIDD FNRKGGMAQM SKALEGPMVL GMTVDTTKKM TVVTQPHKNS IDKAGTPGAE RGACPTTSGV PAEIEAQVPN SNVIFSNIRF GPIGSTVPGL DGSTPSNPTA TVAPPTSTTT VMSVWDDHYA NMLWLDSTYP TPTSQPGGCT TQKNGQCCGGI GYTGCTNCVA GTTCTELNPW YSQCL SVRSSTTQIS |
| SEQ ID NO: 68 | MFHKAVLVAF SLVTIVHGQQ AGTQTAENHP QLSSQKCTAG GSCTSASTSV VLDSNWRWVH EFTFDVDVSN GNTWDASICS DPVSCAQNCA LDGADYAGTY GITTSGDALT LKFVTGSNVG SRVYLMEDET NYQMFKLMNQ SRVYLMEDET WEANSISAAY TPHPCTVTEQ FVQMDQDGT SKFPNNKAGA KFGTGYCDSQ CPQDIKFING EANIVDWTAS AGDANSGTGS FGTCCQEMDI RFYVQNGKVI PNSVVQITGI TRCSGSDCGQ GSDRFNGICD PDGCDFNAFR MGNTEFYGKG LTVDTSQKFT IVTQFISDDG TADGNLAEIR DYPTTADPSQ PGVARGTCPT TSGVPSQVEG QEGSSSVIYS CTQQKTVFGD NIKFGDLNST TNNFAAKGGL KQMGEAVKNG MVLALSLWDD YAAQMLWLDS SPFTCHVLNP YYSQCY FTGTLTNPSS PAGPPVTSSP SEPSQSTQPS QPAQPTQPAG TAAQMAQCCG MGFTGPTVCA |
| SEQ ID NO: 69 | MFRAALLAF TCLAMVSGQQ AGTNTAENHP QLQSQQCTTS GGCKPLSTKV VLDSNWRWVH STSGYTNCYT GNEWNTSLCP DGKTCAANCA LDGADYSGTY GITSTGTALT LKFVTGSNVG SRVYLMADDT HYQLLKLLNQ EFTFDVDMSN LPCGLNGALY LSAMDADGGM SKYPGNKAGA |

TABLE 7-continued

| SEQ ID NO. | Amino acid sequence |
|---|---|
| SEQ ID NO: 70 | KYGTGYCDSQ CPKDIKFING EANVGNWTET TCCSEMDIWE ANNDAAAFTP HPCTTTGQTR CSGDDCARNT GLCDHGDGCD FNSFRMGDKT FLGKGMTVDT SKPFTDVTQF LTNDNTSTGT LSEIRRIYIQ NGKVIQNSVA NIPGVDPVNS ITDNFCAQQK TAFGDTNWFA QKGGLKQMGE ALGNGMVLAL SIWDDHAAM LWLDSDYPTD KDPSAPGVAR GTCATTSGVP SDVESQVPNS QVVFSNIKFG DIGSTFSGTS SPNPPGGSTT SSPVTTSPTP PPTGPTVPQW GQCGGIGYSG STTCASPYTC HVLNPYYSQC Y |
| SEQ ID NO: 71 | MMMKQYLQYL AAALPLVGLA AGQRAGNETP ENHPPLTWQR CTAPGNCQTV NAEVVIDANW RWLHDDNMQN CYDGNQWTNA CSTATDCAEK CMIEGAGDYL GTYGASTGDA ALTLKFVTKH EYGTNVGSRF YLMNGPDKYQ MFNLMGNELA FDVDLSTVEC GINSALYFVA MEEDGGMASY PSNQAGARYG TGYCDAQCAR DLKPVGGKAN IEGWKSSTSD PNAGVPYGS CCAEIDWES NAYAFAFTPH ACTTNEYHVC ETTNCGGTYS EDRFAGKCDA NGCDYNPYRM GNPDFYGKGK TLDTSRKFTV VSRFEENKLS QYFIQDGRKI EIPPPTWEGM PNSSEITPEL CSTMFDVFND RNRFEEVGGF EQLNNALRVP MVLVMSIWDD HYANMLWLDS IYPPEKEGQP GAARGDCPTD SGVPAEVEAQ FPDAQVWSN IRFGPIGSTY DF |
| SEQ ID NO: 72 | MYRSAITPLTF ASLVLGQQVG TYTAERHPSM PIQVCTAPGQ CTRESTEVVL DANWRWTHIT NGYTNCYTGN EWNATACPDG ATCAKNCAVD GADYSGTYGI TTPSSGALRL QFVKKNDNGQ NVGSRVYLMA SSDKYKLFNL LNKEFTFDVD VSKLPCGLNG AVYFSEMLED GGLKSFSGNK AGAKYGTGYC DSQCPQDIKF INGEANVEGW GGADGNSGTG KYGICCAEMD IWEANSDATA YTPHVCSVNE QTRCEGVDCG AGSDRYNSIC DKDGCDFNSY RLGNREFYGP GKTVDTTRPF TIVTQFVTDD GTDSGNLKSI HRYYVQDGNV IPNSVTEVAG VDQTNFISEG FCEBQQKSAFG DNNYFGQLGG MRAMGESLKK MVLVLSIWDD HAVNMNWLDS IFPNDADPEQ PGVARGRCDP ADGVPATIEA AHPDAYVIYS NIKFGAINST FTAN |
| SEQ ID NO: 73 | MYRTLAFASL SLYGAARAQQ VGTSTAENHP KLTWQTCTGT GGTNCSNKSG SVVLDSNWRW AHNVGGYTNC YTGNSWSTQY CPDGDSCTKN CAIDGADYSG TYGITTSNNA LSLKFVTKGS FSSNIGSRTY LMETDKYQM FNLINKEFTF DVDVSKLPCG LNGALYFVEM AADGGIGKGN NKAGAKYGTG YCDSQCPHDI KFINGKANVE GWNPSDADPN GGAGKIGACC PEMDIWEANS ISTAYTPHPC RGVGLQECSD AASCGDGSNR YDGQCDKDGC DFNSYRMGVK DFYGPGATLD TTKKMTVITQ FLGSGSSLSE IKRFYVQNGL VYKNSQSAVA GVTGNSITES FCTAQKKAFG DTSSFAALGG LNEMGASLAR GHVLIMSLWG DHAVNMLWLD STYPTDADPS KPGAARGTCP TTSGKPEDVE SNIKFGPIGS TFAQPA |
| SEQ ID NO: 74 | MYQKLALISA FLATARAQSA CTLQAETHPP LTWQKCSSGG ETHPSLTWQT CSGSGSCTTT SGSVVIDANW RWHEVGGYT NCYSGNTWDS SICSTDTTCA DGAAYASTYG VTTSADSLSI GFVTQSAQKN ASQKNIGSRL YLLADDSTYE TFKLFNREFT FDVDVSNLPC GLNGALYFVS MDADGVSRF GAKYGTGYCD SQCPRDLKFI NGQANVEGWE PSSNNANTGI IEGWEPSSTD TVVTQFITND CCPEMDIWEA NSISSAFTAH PCDSVQQTMC TGDTCGGTYS GTCDPDGCDW NPYRLGNTSF YGPGSSFTLD TTKKLTVVTQ GKTVDMSKFP NSVITVVTQF GTDTGTLTEI RRLYVQNGVI IGNGPSTYTA ASGNSITESF SDKGGLTQFK KATSGMVLV MSLWDDYYAN MLWLDSTYPT NETSSTPGAV DYPTTSCASS PGVARGTCPT TTGNATVVEA NYPNSVTYS NIKFGTLNST YSGTSSGGSS GGNPPGGNPP GTTTIRRPAT STGSSPGPTQ THYGQCGGIG YSGPTVCASG STCQVLNPYY SQCL PTTCASGTCTKQNDYYSQCL |
| SEQ ID NO: 75 | MYRILKSFIL LSLVNMSLSQ KIGKLTPEVH PPMTFQKCSE GGSCETIQGE VVVDANWRWV HSAQQNCYT GNTWNPTICP DDETCAENCY LDGANYESVY GVTTSEDSVR LNFVTQSQGK NIGSRLFLMS NESNYQLFHV LGQEFTFDVD VSNLDCGLNG ALYLVSMDSD GGSARFPTNE AGAKYGTGYC DAQCPRDLKF ISGSANVDGW IPSTNNPNTG YGNLGSCCAE MDLWEANNMA TAVTPHPCDT SSQSVCKSDS CGGAASSNRY GGICDDPDGC YNPYRMGNTS FFGPNKMIDT NSVITVVTQF ITDDGSSDGK LTSIKRLYVQ DGNVISQSVS SPTTSGVPS KVEQNYPNAY VVYSNIKVGP NEEFCTNQKK VFGDEDSFTK HGGLAKMGEA LKDGMVLVLS LWDDYQANML WLDSSYPTTS SPTDPGVARG SCPTTSGVPS KVEQNYPNAY VVYSNIKVGP IDSTYKK |
| SEQ ID NO: 76 | MISRVLAISS LLAAARAQQI GTNTAEVHPA LTSIVIDANW RWLHTTSGYT NCYTGNSWDA TLCPDAVTCA ANCALDGADY SGTYGIITSG NSLKLNFVTK GANTNVGSRT YLMAAGSKTQ YQLLKLLGQE FTFDVDVSNL PCGLNGALYF AEMDADGGVS RFPTNKAGAQ YGTGYCDAQC PODIKFINGQ ANSVGWTPSS NDVNTGTGQY GSCCSEMDIW EANKISAAYT PHPCSVDGQT RCTGDTCGIG ARYSSLCDAD GCDFNSYRMG DTGFYGAGLT VDTSKVFTVV TQFITNDGT NMLWDAPYP ASKPSAAGV VQNGKVIPN SQSKVTGVSG NSITDSFCAA QKTAFGDTNE FATKGGLATM SKALAKGMVL VMSIWDDHSA NMLWLDAPYP ASKPSAAGV SRGSCSASSG VPADVEANSP GASVTYSNIK WGPINSTYSA GTGSNTSGSS GSTTLVSSV PSSTPISTTG VPKYGQCGGS GYTGPTNCIG STCVSMQYY SQCQ |

TABLE 7-continued

| SEQ ID NO. | Amino acid sequence |
|---|---|
| SEQ ID NO: 77 | MYRQVATALS FASLVLGQQV GTLTAETHPS LPIEVCTAPG SCTKEDTTVV LDANWRWTHV TDGYTNCYTG NAWNETACPD GKTCAANCAI DGAEYEKTYG ITTPEGALR LNFVTESNVG SRVYLMAGED KYRLFNLLNK EFTMDVDVSN LPCGLNGAVY FSEMDEDGGM SRFEGNRAGA KYGTGYCDSQ CPRDIKFING EANSEGWGGE DGNSGTGKYG TCCAEMDIWE ANLDATAYTP HPCKVTEQTR CEDDTECGAG DARYEGLCDR DGCDFNSFRL GNKEFYGPEK TVDTSKPFTL VTQFVTADGT DTGALQSIRR FYVQDGTVIP NSETVEGVD PTNEITDDFC AQQKTAFGDN NHFKTIGGLP AMGKSLEKMV LVLSIWDDHA VYMNWLDSNY PTDADPTKPG VARGRCDPEA GVPETVEAAH PDAYVIYSNI KIGALNSTFA AA |
| SEQ ID NO: 78 | MSSFQVYRAA LLLSILATAN AQQVGTYTTE THPSLTWQTC TSDGSCTTND GEVVIDANWR WVHSTSSATN CYTGNEWDTS ICTDDVTCAA NCALDGATYE ATYGVTSSGS ELRLNFVTGG SSKNIGSRLY LMSDDSNYEL FKLLGQEFTF DVDVSNLPCG LNGALYFVAM DADGGTSEYS GNKAGAKYGT GYCDSQCPRD LKFINGEANC DGWEPSSNNV NTGVGDHGSC CAEMDVWEAN SISNAFTAHP CDSVSQTMCD GDSCGGTYSA SGDRYSGTCD PDGCDYNPYR LGNTDFYGPG LTVDTNSPFT VVTQFITDDG TSSGTLTEIK RLYVQNGEVI GVARGTCSTD ANGASTYSSV NGSSITSAFC ESEKTLFGDE NVFDKHGGLE GMGEAMAKGM VLVLSIWDDY AADMLWLDSD YPVNSSASTP GVARGTCSTD SGVPATVEAE SPNAYVTYSN IKFGPTGSTY SSGSSSGSGS SSSSSSTTK ATSTTLKTTS TTSSGSSSTS AAQAYGQCGG QGWTGPTTCV SGYTCTYENA YSSQCL |
| SEQ ID NO: 79 | MYRAIATASA LLATARAQQV CTLNTENKPA LTWAKCTSSG CSNVRGSVVV VHDVNGYTNC YTGNTWDPTY CPDDETCAQN CALDGADYEG TYGVTSSGSS GADYSGTGYV TSSGNQLNLK FVTVGPYSTN VGSRLYLMED ENNYQMFDLL GNEFTFDVDV SNLPCGLNGA LYFVAMDADG GVSKYPNNKA GAKYGTGYCD SOCPRDLKFI GAKYGTGYCD AQCPRDVKFI NGVANSDEWK PSDSDKNAGV GKYGTCCPEM DIWEANKIST AYTPHPCKSL TQQSCEGDAC GGTYSATRYA GTCDPDGCDF NPYRQCNKTF YGPGSGFNVD TTKKVTVVTQ FIKGSDGKLS BIKRLYVQNG KVIGNPQSEI ANNPGSSVTD SFCKAQKVAF NDPDDFNKKG GWSGMSDALA KPMVLVMSLW HDHYANMLWL DSTYPKGSKT PGSARGSCPE DSGPDTLEK EVPNSGVSFS NIKFGPIGST YTGTGGSNPD PEEPEPEEP VGTVPQYGQC GGINYSGPTA CVSPYKCNKI NDFYSQCQ |
| SEQ ID NO: 80 | EQAGTATAEN HPPLTWQECT APGSCTTQNG AVVLDANWRW NREFSFDVDV SNLPCGLNGA LYFVAMDADG GVSKYPNNKA GAKYGTGYCD SOCPRDLKFI LKLNFVTGSN VGSRLYLLQD DSTYQIFKLL NREFSFDVDV DVWEANSISN AVTPHPCDTP GQTMCSGDDC GGTYSNDRYA GTCDPDGCDF NPYRMGNTSF DGEANVEGWQ PSSNNANTGI GDHGSCCAEM DVWEANSISN AVTPHPCDTP GQTMCSGDDC GGTYSNDRYA GTCDPDGCDF NPYRMGNTSF YGPGKIDTT KPFTVTQFL TDDGTDTGTL SEIKRFYIQN SNVIPQPNSD ISGVTGNSIT TEFCTAQKQA FGDTDDFSQH GGLAKMGAAM QQGMVLVMSL WDDYAAQMLW LDSDYPTDAD PTTPGIARGT CPTDSGVPSD VESQSPNSYV TYSNIKFGPI NSTFTAS |
| SEQ ID NO: 81 | MFPPTLAIVSL SFLAIAYGQQ VGTLTAETHP KLSVSQCTAG GSCTTVQRSV VLDSNWRWLH DVGGSTNCYT GNTWDDSLCP DPTTCAANCA LDGADYSGTY GITTSGNALS LKFVTQGPYS TNIGSRVLLL SEDDSTYEMF NLKNQEFTFD VDMSALPCGL NGALYFVEMD KDGGSGRPT NKAGSKYGTG YCDTQCPHDI KFINGEANVL DWAGSSNDPN AGTGHYGSCC ITADNTTSGD NGKVIANSKT TVQQCTPHVC ITDDFCNAQK TDCGDDRY DGICDKDGCD FNSWRMGDQT FLGPGKTVDI SSKFTVVTQF ITADNTTSGD LWLDSDYPTD ADASAPGVSR GPCPTTSGDP TDVESQSPGA TVIFSNIKTG PIGSTFTS TTFGDTNTFE QMGGLATMGD AFETGMVLVM SIWDDHEAKM |
| SEQ ID NO: 82 | MLSASKAAAI LAFCAHTASA WVVGDQQTET HPKLNWQRCT GKGRSSCTNV NGEVVIDANW RWLAHRSGYT NCYTGSEWNQ SACPNNEACT KNCAIEGSDY AGTYGITTSG NQMNIKFIIK RPYSTNIGAR TYLMKDEQNY KKGACCAQMD VWEANSAATA LTPHSCQPAG YSVCEDTNCG GTYSEDRYAG MPQKGQGAPG AKYGTGYCDA QCARDLKFVR GSANAEGWTK SASDPNSGVG SGNQLSEIKR FYVQDGKVIA NPEPTIPGME WCNTQKKVFQ FSNIKFGPIG EEAYPFNEFG TCDANGCDFN PFRVGVKDFY GKGKTVDTTK KMTVVTQFVG DSNWPREADP AKPGVARRDC PTSGGKPSEV EAANPNAQVM STRAHAA GMASMSEGMS QGMVLVMSLW DDHYANMLWL |
| SEQ ID NO: 83 | MFRTATLLAF TMAAMVFGQQ VGTNTARSHP ALTSQKCTKS GGCSNLNTKI VLDANWRWLH EFTFDVDMSN LPCTNAQTR STSGYTNCYT GNQWDATLCP DGKTCAANCA LDGADYTGTY GITASGSSLK LQFVTGSNVG SRVYLMADDT HYQMFQLLNQ TCCTEMDIWE ANNDAAAYTP HPCTTNAQTR CSGSDCTRDT LSAMDADGGM AKYPTNKAGA KYGTGYCDSQ CPRDIKFING EANVEGWNAT SANAGTGNYG TCCTEMDIWE TEIRRLYVQN GKVIQNSSVK IPGIDPVNSI TDNFCSQQKT CSGSDCTRDT GLCDADGCDF NSFRMGDQTF LGKGLTVDTS KPFTVVTQFI TNDGTSAGTL WLDSNYPTNK DPSTPGVARG IGYTGSTTCA SPYTCHVLNP VVFSNIKFGD AFGDTNYPAQ HGGLKQVGEA LRTGMVLALS IWDDYAANML STPPTQPTGV TVPQWGQCGG YYSQCY LNTTYTGTVS SSSVSSSHSS TSTSSSHSSS |
| SEQ ID NO: 84 | MYQRALLFSA LMAGVSAQQV GTQKPETHPP LAWKECTSSG CTSKDGSVVI DANWRVHSV DGYKNCYTGN EWDSTLCPDD ATCATNCAVD GADYAGTYGA TTEGDSLSIN FVTGSNIGSR FYLMEDENKY QMFKLLNKEF TFDVDVSTLP CGLNGALYFV SMDADGGMSK YETNKAGAKY GTGYCDSQCP RDLKFINGKG NVEGWKPSAN DKNAGVGPHG SCCAEMDIWE ANSISTALTP HPCDTNGQTI CEGDSCGGTY STTRYAGTCD PDGCDFNPFR MGNESFYGPG KMVDTKSKMT VVTQFITSDG TDTGSLKEIK RVYVQNGKVI ANSASDVSGI TGNSITSDFC TAQKKTFGDE DVFNKHGGLS GMGDALGEGM VLVMSLWDDH NSNMLWLDGE KYPTDAAASK AGVSRGTCST DSGKPSTVES ESGSAKVVFS NIKVGSIGST FSA |

TABLE 7-continued

| SEQ ID NO. | Amino acid sequence |
|---|---|
| SEQ ID NO: 85 | MTSKIALASL FAAAYGQQIG TYTTETHPSL TWQSCTAKGS CTTQSGSIVL DGNWRWTHST TSSTNCYTGN TWDATLCPDD ATCAQNCALD GADYSGTYGI TTSGDSLRLN FVTQTANKNV GSRVYLLADN THYKTFNLLN QEFTFDVDVS NLPCGLNGAV YFANLPADGG ISSTNKAGAQ YGTGYCDSQC PRDGKFINGK ANVDGWVPSS NNPNTGVGNY GSCCAEMDIW EANSISTAVT PHSCDTVTQT VCTGDNCGGT YSTTRYAGTC DPDGCDFNPY RQGNESFYGP GKTVDTNSVF TIVTQFLITD GTSSGTLNEI KRFYVQNGKV IPNSESTISG VTGNSITTPF CTAQKTAFGD PTSFSDHGGL ASMSAAFEAG MVLVLSLWDD YYANMLWLDS TYPTTKTGAG GPRGTCSTSS GVPASVEASS PNAYVVYSNI KVGAINSTFG |
| SEQ ID NO: 86 | MYTKFAALAA LVATVRGQAA CSLITAETHPS LQMQKCTAPG SCTTVSGQVT TNSSTNCYTG NEWDTSICSS DTDCATKCCL DGADYTGTYG VTASGNSLNL KFVTQGPYSK NIGSRMYLME SESKYQGFTL LGQEFTFDVD VSNLGCGLNG ALYFVSMDLD GGVSKYTTNK AGAKYGTGYC DSQCPRDLKF INGQANIDGW QPSSNDANAG LGNHGSCCSE MDIWEANKVS AAYTPHPCTT IGQTMCTGDD CGGTYSSDRY AGICDDPDGCD FNSYRMGDTS FYGPGKTVDT GSKFTVVTQF LTGSDGNLSE IKRFYVQNGK VIPNSESKIA SGVPADVESQ APNSNVIYSN IRFGPINSTY DTNVFEERGG LAQMGKALAE PMVLVLSVWD DHAVNMLWLD STYPTDSTKP HWGQCGQGW TGPTVCQSPY TCKYSNDWYS QCL TGTPSGNPP GGGTTTTTTT TTSKPSGPTT TTNPSGPQQT |
| SEQ ID NO: 87 | MYQRALLFSA LLSVSRAQQA GTAQEEVHPS LTWQRCEASG SCTEVAGSVV LDSNWRWTHS VDGYTNCYTG NEWDATLCPD NESCAQNCAV DGADYEATYG ITSNGDSLTL KFVTGSNVGS RVILMEDDET YQMFDLLNNE FTFDVDVSNF PCGLNGALYF TSMDADGGLS KYEGNTAGAK YGTGYCDSQC PRDIFINGL GNVEGWEPSD SDANAGVGNY GTCCPEMDIW EANSISTAYT PHPCDSVEQT MCEGDSCGGT YSDDRYGGTC DPDGCDFNSY RMGNTRFYGP GAIIDTSSKF TVVTQFIADG GSLSEIKRFY VQNGEVIPNS ESNISGVEGN SITSEFCTAQ KTAFGDEDIF AQHGGLSAMG DAASAMVLIL SIWDDHHSSM MWLDSSYPTD ADPSQPGVAR GTCEQGAGDP DVVRSEHADA SVTFSNIKFG PIGSTF |
| SEQ ID NO: 88 | MMMKQYLQYL AAGSLMTGLV AGQGVGTQQT ETHPRITWKR CTGKANCTTV QAEVVIDSNW RWIHTSGGTN CYDGNAWNTA ACSTATDCAS KCLMEGAGNY QQTYGASTSG DSLTLKFVTK HEYGTNVGSR FYLMNGASKY QMFTLMNNEF TFDVDLSTVE CGLNSALYFV AMEDGGMRS YPTNKAGAKY GTGYCDAQCA RDLKFVGGKA NIEGWRESSN DENAGVGPYG GCCAELDVWE EQFFVQNGQK SNAHAYAFTP ILAAPTFDG CERDTCGGTY SEDRFAGGCD ANGCDYNPYR MGNPDFYGKG KTVDTTKKFT VVTRFQDDNL DSGVPSEVKA NYPNAKVVWS NIRFGPIGST FCSTQFDVFT DRNRFREVGD FPQLNAALRI PMVLVMSIWA DHYANMLWLD SVYPPEKEGE PGAARGPCAQ VNV |
| SEQ ID NO: 89 | MYQRALLFSF FLAAARAQQA GTVTAENHPS LTWQQCSSGG SCTTQNGKVV IDANWRWVHT TSGYTNCYTG NTWDTSICPD DVTCAQNCAL GADYSGTYG VTTSGNALRL NFVTQSSGKN IGSRLYLLQD DTTYQIFKLL GQEFTFDVDV SNLPCGLNGA LYFVAMDADG GLSKYPGNKA GAKYGTGYCD SQCPRDLKFI NGQANVEGWQ PSANDPNAGV GNHGSCCAEM DWEANSIST AVTPHPCDTP GQTMCQGDDC GGTYSSTRYA GTCDPDGCDF NPYRQGNHSY YGPGKIVDTS SKFTVVTQFI SKFFVVTQPI TDDGTPSGTL TEIKRFYVQN GKVIPQSEST ISGVTGNSIT TEYCTAQKAA FGDNTGFFTH GGLQKISQAL AQGMVLVMSL WDDHAANMLW LDSTYPTDAD CPTTSGVPAD VESQNPNSYV IYSNIKVGPI NSTFTAN |
| SEQ ID NO: 90 | MFAIVILLGLT RSLGTGTNQA ENHPSLSWQN CRSGGSCTQT SGSVVLDSNW RWTHDDSSLTN FTVDDSNLDC CYDGNEWSSS LCPDPKTCSD NCLIDGADYS GTYGITSSGN SLKLVFVTNG PYSTNIGSRV YLLKDESHYQ IFDLKNKEFT FTVDDSNLDC GLNGALYFVS MDEDGGTSRF SSNKAGAKYG TGYCDAQCPH DIKFINGEAN VENWKPQTND ENAGNGRYGA CCTEMDIWEA NKYATAYTPH KYVQGGKVIE NTVVNIAGMS SGNSITDDFC NEQKSAFGDT NDFEKGGLS GLGKAFDYGM DGCDFNSYRM GNTSFWGPGL IIDTGKPVTV VTQFVTKDGT DNGQLSEIRR VTQFVTKDGT GVRRGPCATS SGAPSDVESQ HPDSSVTFSD IRFGPIDSTY VLVLSLWDDH QVNMLWLDSI YPTDQPASQP |
| SEQ ID NO: 91 | MHQRALLFSA LVGAVRAQQA GTLTEEVHPP LTWQKCTADG RVLIMAEDDE SYQTFDLVGN EFTFDVDVSN TNGSTNCYTG LPCGLNGALY NTWDESLCPD FTSMDADGGV NEACAANCAL SKYPANKAGA DGADYRSTYG ITTSGDALTL TFVTGENVGS DNDKNAGVGG HGSCCPELDI WEANSLSSAF YVQNGKVIAN AQSNVDGVTG NSITSDFCTA TMCSGDDCCG TYSETRYAGT QKTAFGDQDI KYTGDYCDSQ CPRDLKFING MANVEGWTPS PDKIVDTNSV MTVVTQFIGD GGSLSEIKRL YYQNGKVIAN AQSNVDGVTG NSITSDFCTA ATVTFSKIKF GPIGSTYSSN STA CPDPDGCDFNA VRMGNTSYYG LSIWDDHHNSS MMWLDSTYPE DADASEPGVA RGTCEHGVGD PETVESQHPG FSKHGGLSGM GDAMSAMVLI |
| SEQ ID NO: 92 | MFRAAALLAF TCLAMVSGQQ AGTNTAENHP QLQSQQCTTS GGCKPLSTKV VLDSNWRWVH STSGYTNCYT GNEWDTSLCP DGKTCAANCA LDGADYSGTY GITSTGTALT LKFVTSGNVG SRVYLMADDT HYQLLKLLNQ EFTFDVDMSN LPCGLNGALY LSAMDADGGM SKYPGNKAGA KYGTGYCDSQ CPKDIKFING EANVGNWTET GSNTGTSYG TCCSEMDIWE ANNDAAAFTP GKVIQNSVAN HPCTTTGQTR CSGDDCAARNT GLCDGDGCDF NSFRMGDKTF LGKGMIVDTS KPFTVVTQFL TNDNTSTGTL SEIRRIYIQN DPSAPGVARG TTCASPYTCH VLNPCESILS LQRSSNADQY VVFSNIKFGD AFGDTNWFAQ KGGLKQMGEA LGNGMVLALS IWDDHAANML WLDSDYPTDK DPSAPGVARG PNPPGGSTTS SPVTISPTPP PTGPTVPQWG QCGGIGYSGS TTCASPYTCH VLNPCESILS LQRSSNADQY LQTTRSATKR RLDTALQPRK |

TABLE 7-continued

| SEQ ID NO. | Amino acid sequence |
|---|---|
| SEQ ID NO: 93 | MRTALALILA LAAFSAVSAQ QAGTITAETH PTLTIQQCTQ SGGCAPLTTK VVLDVNMRWI HSTTGYTNCY SGNTWDAILC PDPVTCAANC ALDGADYTGT FGILPSGTSV TLRPVDGLGL RLFLLADDSH YQMFQLLNKE FTFDVEMPNM RCGSSGAIHL TAMDADGGLA KYPGNQAGAK YGTGFCSAQC PKGVKFINGQ ANVEGWLGTT ATTGTGFFGS CCTDIALWEA NDNSAFAPH PCTTNSQTRC SGSDCTADSG LCDADGCNFN SFRMGNTEFF GAGMSVDTTK LFTVVTQFIT SDNTSMGALV EIHRLYIQNG QVIQNSVVNI PGINPATSIT PTPSVVFSNI FGTSSFAQH GGLAQVGEAL RSGMVLALSI VNSAADTLWL DSNYPADADP SAPGVARGTC PQDSASIPEA PTPSVVFSNI KLGDIGTTFG AGSALFSGRS PPGPVPGSAP ASSATATAPP FGSQCGGLGY AGPTGVCPSP YTCQALNIYY SQCI |
| SEQ ID NO: 94 | MYQRALLFSF FLAAARAHEA GTVTAENHPS LTWQQCSSGG SCTTQNGKVV IDANWRWVHT TSGYTNCYTG NTWDTSICPD DVTCAQNCAL DGADYSGTYG VTTSGNALRL NFVTQSSGKN IGSRLYLIQD DTTYQIFKLL GQEFTFDVDV SNLPCGLNGA LYFVAMDADG NLSKYPGNKA GAKYGTGYCD SQCPRDLKFI NGQANVEGWQ PSANDPNAGV GNHGSSCAEM DWEANSIST AVTPHPCDTP GQTMCQGDDC GGTYSSTRYA GTCDTDGCDF NPYQPGNHSF YGPGKIVDTS SKFTVVTQFI TDDGTPSGTL TEIKRFYVQN GKVIPQSEST ISGVTGNSIT TEYCTAQKAA FDNTGFFTHG GLQKISQALA QGMVLVMSLW DDHAANMLWL DSTYPTDADP DTPGVARGTC PTTSGVPADV ESQNPNSVVI YSNIKVGPIN STFTAN |
| SEQ ID NO: 95 | MHKRAATLSA LVVAAAGFAR GQGVGTQQTE THPKLTFQKC SAAGSCTTQN GEVVIDANWR WVHDKNGYTN CYTGNEWNTT ICADAASCAS NCVVDGADYQ GTYGASTSGN ALTLKFVTKG SYATNIGSRM YLMASPTKYA MFTLLGHEFA FDVDLSKLPC GLNGAVYFVS MDEDGGTSKY PSNKAGAKYG TGYCDSQCPR DLKFIDGKAN SASWQPSSND QNAGVGGMGS CCAEMDIWEA NSVSAAYTPH PCQNYQQHSC SGDDCGGTYS ATRFAGDCDF NPYQPGNHSF YGPGKIVDTS SKFTVVTQFI TDDGTPSGTL TEIKRFYVQN GKVIPQSEST ITPDFCKAQK ATRFAGDCDF GVHDFYGKFSI VTQFKGSGST GMLDSTYPTD ADPSAPGKGR GTCDTSSGVP SDVESKNGDA TVIYSNIKFG PLDSTYTAS QVFGDDPDRFN DMGGFTNMAK ALANPMVLVL SLWDDHYSNM |
| SEQ ID NO: 96 | MRASLLAFSL NSAAQQOAGT LQTKNHPSLT SQKCRQGGCP QVNTTIVLDA NWRWTHSTSG STNCYTGNTW QATLCPDGKT CAANCALDGA DYTGTYGVTT SGNSLTLQFV TQSNVGARLG YLMADDTTYQ MPNLLNQEFW FDVDMSNLPC GLNGALYFSA MARTAAWMPM VVCASTPLIS TRRSTARLLR LPVPPRSRYG RGICDSQCPR DIKFINGEAN VOGMQPSPND TNAGTGNYGA VQFQFNRSSRV VEPISWTKQT TLHLGNLPWK SADCNVQNGR VIQNSKVNIP SGTACGGGSN RYGSICDHDG LGFQNLFGMG RTRVRARVGR GGMANMSEAL RRGMVLVLSI WDDHAANMLW LDSITSAAAC RSTPSEVHAT PLRESQIRSS CAANCALDGA GMPSTMDSVT TEFCNAQKTA FNDTFSFQQK GSSTPPQPTG VTVPQGQCGG IGYTGPTTCA SPTTCHVLNP YYSQCY TGTTYTTGSV PTTSTSTGTT |
| SEQ ID NO: 97 | MKQYLQYLAA ALPLMSLVSA QGVGTSTSET HPKITWKKCS SGGSCSTVNA EVVIDANWRW LHNADSKNCY DLSTVECGLN SALYFVAMEE SDDCTSKCV LEGAEYGKTY GASTSGDSLS LKFLTKHEYG TNIGSRFYLM NGASKYQMFT LMNNEFAFDV EIDVWESNAH AFAFTPHACE NNNYHVCEDT DGMASYSTN KAGAKYGTGY CDAQCARDLK FVGGKANYDG WTPSSNDANA GVGALGGCCA FQENKLTQFF VQNGKKIEIP GPKHEGLPTE SSDITPELCS TCGGTYSEDR FAGDCANGC DYNPYRVGNT DFYGKGMTVD TSKKFTVVSQ ANMLWLDSSY PPEKAGTPGG DRGPCAQDSG VPSEVESQYP DATVVWSNIR AMPEVFGDRD RRAEVGGFDA LNKALAVPMV LVMSIWDDHY FGPIGSTVQV |
| SEQ ID NO: 98 | MFPKASLIAL SFIAAVVYGQQ VGTQMAEVHP KLPSQLCTKS GCTTQNQTAVV LDANWRWLHT TSGYTNCYTG NSWDATLCPD ATTCAQNCAV DGADYSGTYG ITTSGNALTL KFKTGTNVGS RVYLMQTTHA YQMFQLLNGE FTFDVDMSNL PCGLNGALYL SQMDQDGGLS KFPTNKAGAK YGTGYCDSQC PHDIKFINGM ANVAGWAGSA SDPNAGSGTL GTCCSEMDIW EANNDAAAFT PHPCSVDGQT QCSGTQCGDD DERYSGLCDK DGCDFNSFRM GDKSFLGKGM KMGAALKSGM TVDTSRKFTV VTQFVTTDGT TNGDLHEIRR LYVQDGKVIQ NSVVSIPGID SGLPTNVESQ AQQKSVFGDT NYFATLGGLK TGSTSPSS PAGPVSSSTS VASQPTPAQ GTVAQWGQCG GTVGFTGPTVC ASPFTCHVUN PYYSQCY |
| SEQ ID NO: 99 | MFRTAALLSF AYLAVVYGQQ AGTSTAETHP PLTWEQCTSG GSCTTQSSSV VLDSNWRWTH VVGGYTNCYT GNEWNTTVCP DGTTCAANCA LDGADYEGTY GISTSGNALT KFVTASAQT NVGSRVYLMA PGSETEYQMF NPLNQEFTFD VDVSALPCGL ISEALTPHPC TAQGTACTG ADGGLSEYPT NKAGAKYGTG YCDSQCPRDI KFIEGKANVE GWTPSSTSPN AGTGGTGICC NEMDIWEANS TAIRRIYVQN GQVIQNSMSN IAGVTPTNEI DSCSSPNSTA GICDDQAGCDF NSFRMGDTSF YGPGLTVDTT SKITVVTQFI TSDNTTGDL WLDSTYPVGK TGPGAARGTC ATTSGQPDQV ETQSPNAQVV FSNIKFGAIG AFGDTNTESE KGGLTGMGAA FSRGMVLVLS IWDDDAAEML TQTKYGQCGG QGWTGATVCA SGSTCTSSGP YYSQCL STFSSTGTGT GTGTGTGT GTTTSSAPAA |
| SEQ ID NO: 100 | MFRTAALTAF TFAAVVLGQQ VGTLTTENHP ALSIQQCTAT GCTTQQKSVV LDSNWRWTHS TAGATNCYTG NAWDPALCPD PATCATNCAI LDGADYSGTYG ITTSGNALTL RFVTNGQYSQ NIGSRVLLD DADHYKLFDL KNQEFTFDVD MSGLPCGLNG ALYFSEMAAD GGKAAHAGNN AGAKYGTGYC DAQCPHDIKW INGEANVLDW SASATDDNAG NGRYGACCAE MDIWEANSEA TAYIPHVCRD EGLYRCSGTE CGDGNNRYGG VCDKDGCDFN SYRMGDKNFL GRGKTIDTTK KVTVVTQFIT DNNTPTGNLV EIRRVVYQNG VVYQNSFSTF PSLSQYNSIS DEFCVAQKTL |

TABLE 7-continued

| SEQ ID NO. | Amino acid sequence |
|---|---|
| SEQ ID NO: 101 | MYRAIATASA LIAAVRAQQV CSLTPETKPA LSWSKCTSSG CSNVQGSVTI DANWRWTHQL SGSTNCYTGN KWDTSICTSG KVCAEKCCID GAEYASTYGI TSSGNQLSLS FVTKGTYGTN IGSRTYLMED ENTYQMFQLL GNEFTFDVDV SNIGCGLNGA LYFVSMDADG GKAKYPGNKA GAKYTGYCD AQCPRDVKFI NGQANSDGWQ PSKSDVNGGI GNLGTCCPEM DIWEANSIST AHTPHPCTKL TQHSCTGDSC GGTYSEDRYG GTCDADGCDF NAYRQNKTFG YGPGSGFNVD TTKKVTVTQ FHKGSNGRLS EITRLYVQNG KVIANSESKI AGVPGSSLTP EPCTAQKKVF GDIDDFEKKG AWGGMSDALE APMVLVMSLW HDHHSNMLWL DSTYPTDSTK LGAQRGSCST SSGVPADLEK NVPNSKVAFS NIKFGPIGST YKEGQPEPTN PTNPNPTTPG GTVDQWGQCG GTNYSGPTAC KSPFTCKKIN DFYSQCQ |
| SEQ ID NO: 102 | MFRTATLLAF TMAAMVFGQQ VGTNTAENHR TLTSQKCTKS GGCSNLNTKI VLDANWRWLH STSGYTNCYT GNOWDATLCP DGKTCAANCA LDGADYTGTY GITASGSSLK LQFVTGSNVG SRVYLMADDT HYQMFQLLNQ EFTFDVDMSN LPCGLNGALY LSAMDADGGM AKYPTNKAGA KYGTGYCDSQ CPRDIKFING EANVEGWNAT SANAGTYNPH TCCTEMDIWE ANNDAAAYTP HPCTTNAQTR CSGSDCTRDT GLCDADGCDF NSFRMGDQTF LGKGLTVDTS KPFTVVTQFI TNDGTSAGTL TEIRRLYVQN GKVIQNSSVK IPGIDLVNSI TDNFCSQQKT AFGDTNYFAQ HGGLKGVGEA LRTGMVLALS IWDDYAANML WLDSNYPTNK DPSTPGVARG TCATTSGVPA QIEAQSPNAY VVFSNIKFGD LNTTYTGTVS STPPTQPTGV TVPQNGQCGG IGYTGSTTCA SPYTCHVLNP YYSQCY |
| SEQ ID NO: 103 | MYQTSLLASL SFLLATSQAQ QVGTQTAETH PKLITQKCTT AGGCTDQSTS IVLDANWRWL HTVDGYTNCY TGQEWDTSIC TDGKTCAEKC ALDGADYEST YGISTSGNAL TMNFVTKSSQ TNIGGRVLLL AADSDDTYEL FKLKNQEFTF DVDVSNLPCG LNGALYFSEM DSDGGLSKYT TNKAGAKYGT GYCDTQCPHD IKFINGEANV QNWTASSTDK NAGTGHYGSC CNEMDIWEAN SQATAFTPHV CEAKVEGQYR CEGTECGDGD NRYGGVCHCD GCDFNSYRMG NETFYGSNGS TIDTTKKFTV VTQFITADNT ATGALTEIRR KYVQNDVVIE NSYADYETLS KFNSITDDFC AAQKTLSGDT NDFKTKGGIA RMGESFERGM VLVMSVWDDH AANALWLDSS YPTDADASKP GVKRGPCSTS SGVPSDVEAN DADSSVIYSN IRYGDIGSTF NKTA |
| SEQ ID NO: 104 | MFSKVALTAL CFLAVAQAQQ VGREVAENHP RLPWQRCTRN GGCQTVSNGQ VVLDANWRWL LLNKEFTFDV DVSKVPCGIN GALYFIQMDA SDGATCAQRC ALEGANYQQT YGITTSGDAL TIKFLTRSEQ TNIGARVYLM ENEDRYQMFN GKGQYGICCA EMDIWEANSI SNAYTPHPCQ TVNDGGYQRC QGRDCNQPRY RAGAKYTGY CDSQCPRDIK FINGEANSVG WEPSETDPNA NRKMTVVTQF ITHDNTDTGT LVDIRRLYVQ DGRVIANPPT NFPGLMPAHD SITQEFCDDA EGLCDDPDGD YNPFRMGNKD FYGPGKTVDT NRKMTVVTQF VTQFITADNT MLWLDSNYPT DADPNKPGIA RGTCPTTGGS PRDTEQNHPD AQVIFSNIKF KRAFEDNDSF GRNGGLAHMG RSLAKGHVLA LSIWNDHTAH GDIGSTFSGN |
| SEQ ID NO: 105 | MYRKLAVISA FLAAARAQQV CTQQAETHPP LTWQKCTASG CTPQQGSVVL DANWRWTHDT KSTTNCYDGN TWSSTLCPDD ATCAKNCCLD GANYSGTYGV TTSGDALTLQ FVTASNVGSR LYLMANDSTY YLMADDTQYQ ANGIGDHGSC SCCSEMDIWE SFDVDVSQLP CGLNGALYFV SMDADGGQSK YPGNAAGAKY GTGYCDSQCP RDLKFINGQA NVEGWEPSTN NANTGVGLYM ANSISEALTP HPCETVGQTM CSGDSCGGTY SNDRYGGTCD PDGCDWNPYR LGNTSFYGPG SSFALDTTKK LTVVTQFATD GSISRYYVQN GVKFQQPNAQ VGSYSGNTIN TDYCAAEQTA FGGTSFTDKG GLAQINKAFQ GGMVLVMSLW DDYAVNMLWL DSTYPTNATA STPGAKRGSC GYTCQVLNPF YSQCL |
| SEQ ID NO: 106 | MRASLLAFSL AAAVAGGQQA GTLTAKRHPS LTWQKCTRGG CPTLNTTMVL MLELLNQELW FDVDMSNIPC CSEMDIWEAN KVSTAFTPHP SGSTKCYTGN GLNGALYLSA MDADGGMRKY PTNKAGAKYA KSCAANCALD GADYTGYGI TSGGWSLTLQ FVTNVGARA YLMADDTQYQ ANGIGDHGSC CSEMDIWEAN KVSTAFTPHP CTTIEQHMCE NVDGVSGNSI TQSFCKSQKT DRYGVLCDAD TGYCDAQCPR DLKYINGIAN VEGWTPSTND TQFIKDSAGD LAEIKAFYVQ NGKVIENSQS ANAPNSKVAF SNIKFGHLGI AFGDIDDFNK GCDFNSYRMG NTTFYGEGKT VDTSSKFTVV TQFIKDSAGD LAEIKAFYVQ VPGAYRGSGP IGFSGPTTCP EPYTCAKDHD IYSQCV SPPSGGSGT KGGLKQMGKA LAQAMLVMS IWDDHAANML WLDSTYPVPK VPGAYRGSGP IGFSGPTTCP EPYTCAKDHD IYSQCV PPSNPSSSAS PTSSTAKPSS TSTASNPSGT GAAHWAQCCG |
| SEQ ID NO: 107 | MLASTFSYRM YKTALILAAL LGSGQAQQVG TSQAEVHPSM TWQSCTAGGS CTTNNGKVVI DANWRWVHKV GDYTNCYTGN TWDKTLCPDD ATCASNCALE GANYQSTYGA TTSGDSLRLN FVTSQQKNI GSRLYMMDD TTYEMFKLLN NHGSCCAEMD IWEANSISTA FTPHPCDTPG YFVAMDADGG MSKYPTNKAG AKYGTGYCDS TCDPDGCDFN SFRQGNKTFY GPGMTVDTKS KFTVVTQFIT DDHAANMLWL DSNYPTTASS STPGVARGTC DISSGVPADV EANHPDASVV DYCTAQKSLF KDQNVFAKHG GMEGMGAALA QGMVLVMSLW QGMVLVMSLW DDHAANMLWL DSNYPTTASS STPGVARGTC DISSGVPADV EANHPDASVV YSNIKVGPIG STFNSGGSNP GGGTTTAKP TTTTAGSP GGTGVAQHYG QCGGNGWQGP TTCASPYTCQ KLNDFYSQCL |

FGDNQYNTH GGTTKMGDAF DNGMVLIMSL WSDHAAHMLW LDSDYPLDKS PSEPGVSRGA CPTSGDPDD VVANHPNASV TFSNIKYGPI GSTFGGSTPP VSSGGSVPP VTSTTSSGTT TPTGPTGTVP KWGQCGIGY SGPTACVAGS TCTYSNDWYS QCL SSSVSSSHSS TSTSSSHSSS

TABLE 7-continued

| SEQ ID NO. | Amino acid sequence |
|---|---|
| SEQ ID NO: 108 | MQIKQYLQYL AAALPLVNMA AAQRAGTQQT ETHPRLSWKR CSSGGNCQTV NAEIVIDANW RWLHDSNYQN CYDGNRWTSA CSSATDCAQK CYLEGANYGS TYGVSTSGDA LTLKFVTKHE YGTNIGSRVY LMNGSDKYQM FTLMNNEFAF DVDLSKVECG LNSALYFVAM EEDGGMRSYS SNKAGAKYGT GYCDAQCARD LKFVGGKANI EGWRPSTNDA NAGVPYGAC CAEIDWESN AYAFAFTPHG CLNNNYHVCE TSNCGGTYSE DRFGGLCDAN GCDYNPYRMG NKDFYGKGKT VDTSRKFTVV TRFEENKLTQ FFIQDGRKID IPPPTWPGLP NSSAITPELC TNLSKVFDDR DRYEETGGFR TINEALRIPM VLVMSIWDGH YASMLWLDSV YPPEKAGOPG AERGPCAPTS GVPAEVEAQF PNAQVIWSNI RFGPIGSTYQ V |
| SEQ ID NO: 109 | MTSRIALVSL FAAVGQQVG TYQTETHPSL TWQSCTAKGS CTTNTGSIVL DGNWRWTHGV GTSTNCYTGN TWDATLCPDD ATCAQNCALE GADYSGTYGI TTSGNSLRLN FVTQSANKNI GSRVYLMADT THYKTFNLLN QEFTFDVDVS NLPCGLNGAV YFANLPADGG ISSTNTAGAE YGTGYCDSQC PRDMKFPIKGQ ANVDGWVPSS NNANTGVGNH GSCCAEMDIW EANSISTAVT PHSCDTVTQT VCTGDDCGGT YSSSRYAGTC DPDGCDFNSY RMGDETFYGP GKTVDTNSVF TVVTQFLITD GTASGTLNEI KRFYVQDGKV IPNSYSTISG VSGNSITTPF CDAQKTAFGD PTSFSDHGGL ASMSAAFEAG MVLVLSLWDD YYANMLWLDS TYPVGKTSAG GPRGTCDTSS GVPASVEASS PNAYVVYSNI KVGAINSTYG |
| SEQ ID NO: 110 | MFVFVLLWLT QSLGTGTNQA ENHPSLSWQN CRSGGSCTQT SGSVVLDSNW RWTHDSSLTN CYDGNEWSSS LCPDPKTCSD NCLIDGADYS GTYGITSSGN SLKLVFVTNG PYSTNIGSRV YLLKDESHYQ IFDLKNKEFT FTVDDSNLDC GLNGALYFVS MDEDGGTSRF SSNKAGAKYG TGYCDAQCPH DIKFINGEAN VENWKPQTND ENAGNGRYGA CCTEMDIWEA NKYATAYTPH ICTVNGEYRC DGSECGDTDS GNRYGGVCDK DGCDFNSYRM GNTSFWGPGL IIDTGKPVTV VTQFVTDGT DNGLGSIRR KYVQGKVIE NTVVNIAGMS SGNSITDDFC NEQKSAFGDT NDFEKKCGLS GLGKAPDYGM VLVLSLWDDH QVNMLWLDSI YPTDQPASQP GVKRGPCATS SGAPSDVESQ HPDSSVTFSD IRRGPIDSTY |
| SEQ ID NO: 111 | MFRKAALLAF SFLAIAHGQQ VGTNQAENHP SLPSQKCTAS GCTTSSTSVV LDANWRWVHT TTGYTNCYTG QTNDASICPD GVTCAKACAL DGADYSGTYG ITTSGNALTL QFVKGTNVGS RVYLLQDASN YOMFQLINQE FTFDVDMSNL PCGLNGAVYL SQMDQDGGVS RPPTNTAGAK YGTGYCDSQC PRDIKFINGE ANVEGWTGSS TDSNSGTGNY GTCCSEMDIW EANSVAAAYT PHPCSVNQQT NSKVSIAGID AVNSITDDFC DDRYDGVCDP DGCDFNSFRM GDQTFLGKGL TVDTSRKFTI VTQFISDDGT TSGNLAEIRR FYVQDGNVIP GVARGTCPTT SGFPRDVESQ TQQKTAFGDT NRFAAQQGLK QMGAALKSGM VLALSLWDDH AANMLWLDSD YPTTADASNP GATTCVSPY TCHVNAYYS IKWGDLNSTF TGTLTTPSGS SSPSPASTS GSSTSASSSA SVPTQSGVA QWAQCGGIGY QCY |
| SEQ ID NO: 112 | MYRAIATASA LIAAARAQQV CTLTTETKPA LTWSKCTSSG FVTKGSFSTN IGSRTYLMEN CTDVKGGSVGI DANWRWTHQT SSSTNCYTGN KWDTSVCTSG ETCAQKCCLD GADYAGTYGI TSSGNQLSLG FVTKGSFSTN NGKANSDGWK PSDSDINAGI GNMGTCCPEM DIWEANSIST AFTPHPCTKL TQHACTGDSC GKARYPANKA GAKYGTGYCD AQCPRDVKFI NGKANSDGWK YGRGSDFNVD TTKKVTVTQ FKKGSNGRLS EITRLYVQNG KVIANSESKI TTSGVPSDLE PGNSGSSLTA DFCSKQKSVF GTCDADGCDF NSYRQCNKT IKFINGEAN SPPMVLVMSL WHDHHSNMLW LDSTYPTDST TGPKDCKSPY TCKKINDFYS RDVPNSKVSF SNIKFGPIGS GDIDDFSKKG GWSGMSDALE PSSTDTSTTP TNPPTGGTVG QYQCGGQTY QCQ TYSSGTTNPP |
| SEQ ID NO: 113 | MSSFQIYRAA LLLSLIATAN AQQVGTYTTE THPSLTWQTC TSDGSCTTND GEVVIDANWR WVHSTSSATN CYTGNEWDTS ICTDDVTCAA NCALDGATYE ATYGVTTSGS ELRLNFVTQG SSKNIGSRLIY LMSDDSNYEL FKLLGQEFTF DVDVSNLPCG LNGALYFVAM DADGGTSEYS GNKAGAKYGT GYCDSQCPRD LKFINGEANC DGWEPSSNNV NTGVDHGSC CAEMDVWEAN SISNAFTAHP CDSVSQTMCD GDSCGGTYSA SGDRYSGTCD PDGCDYNPYR LGNTDFYGPG LTVDTNSPPT VVTQFITDDG TSSGTLTEIK RLYVQNGEVI ANGASTYSSV NGSSITSAFC ESEKTLFGDE YRMGNDSFYG GMGEAMAKGM VLVLSLWDPG AADMLWLDSD YPVNSSASTP GVARGTCTSD SGVPATVEAE SPNAYVTYSN IKFGPIGSTY SSGSSSGSGS SSSSSSSTTK ATSTTLKTTS TTSSGSSSTS AAQAYQCGG QWTGPTTCV SGTCTYENA YYSQCL |
| SEQ ID NO: 114 | MHQRALLFSA LLTAVRAQQA GTLTEEVHPS LTWQKCTSEG SCTEQSGSVV IDSNWRWTHS VNDSNCYTGN NTWDATLCPD DETCAANCAL DGADYESTYG VTTDGDSLTL KFVTQSNVGS RLYLMDTSDE GYOTFNLLDA EFTFDVDVSN LPCGLNGALY FTAMLDADGGV SKYPANKAGA KYGTGYCDSQ CPRDLKFIDG QANVDGWEPS PGKTIDTGSK MTVVTQFITD GSGSLSEIKR YYVQGNVIA ARGTCDSESG VPATVEGAHP DSSVTFSNIK CGGTYSATDRY CPDGCDFNP YRMGNDSFYG ISDAMSSMVL ILSLWDDYYA SMEWLDSDYP ENATATDPGV IFAEHNGLAG AQKKAFGDED FGPINSTFSA SA |
| SEQ ID NO: 115 | MYAKFATLAA LVAGAAQNA CTLTAENHPS LTWSKCTSGG NIGSRTYLME SDTKYQMFQL LGNEFTFDVD IDANWRWTHR TDSATNCYEG NKWDTSYCSD GPSCASKCCI DGADYSSTYG ITTSGNSLNL KFVTKGQYST ALYFVMDDAD GGMSKYSGNK SNLGCGLNG VSNLGCGLNG AGAKYGTGYC DSQCPRDLKF INGEANVENM QSSTNDANAG TGKYGSCCSE MDVWEANNMA AAFTPHPCXV IGQSRCEGDS CGTYSTDRY AGICDPPGCD FNSYRQGNKT FYGKMTVDI ILSLWDDYYA TKKITVTQF LKNSAGELSE IKRFYVQNGK VIPNSESTIP GVEGNSITQD WCDRQKAAFG |

TABLE 7-continued

| SEQ ID NO. | Amino acid sequence |
|---|---|
| | DVTDXQDKGG MVQMGKALAG PMVLVMSIWD DHAVNMLMLD STWPIDGAGK PGAERGACPT TSGVPAEVEA EAPNSNVIFS NIRFGPIGST VSGLPDGGSG NPNPPVSSST PVPSSSTTSS GSSGPTGGTG VAKHYEQCGG IGFTGPTQCE SPYTCTKLND WYSQCL |
| SEQ ID NO: 116 | MYAKFATLAA LVAGASAQAV CSLITAETHPS LTWQKCTAPG SCTNVAGSIT IDANWRWTHQ TSSATNCYSG SKMDSSICTT GTDCASKCCI DGAEYSTYG ITTSGNALNL KFVTKGQYST NIGSRTYLME SDTKYQMFKL LGNEFTFDVD VSNLGCGLNG ALYPVSMDAD GGMSKYSGNK AGAKYGTGYC DAQCPRDLKF INGEANVEGW ESSTNDANAG SGKYGSCCTE MDVWFANNMA TAFTPHPCTT IGQTRCEGDT CGGTYSSDRY AGVCDDPGCD FNSYRQGNKT FYGKGMTVDT TKKITVVTQF LKNSAGELSE IKRFYAQDGK VIPNSESTIA GIPGNSITKA YCDAQKTVFQ NTDDFTAKGG LVQMGKALAG DMVLVMSVWD DHAVNMLWLD STYPTDQVGV AGAERGACPT TSGVPSDVEA NAPNSNVIFS NIRFGPIGST VQGLPSSGGT SSSSSAAPQS TSTKASTTTS AVRTTSTATT KTTSSAPAQG TNTAKHWQQC GGNGWTGPTV CESPYKCTKQ NDWYSQCL |
| SEQ ID NO: 117 | MLTLVFFLLS LVVSLEIGTQ QSEDHPKLTW IVLDSNWRWV HDSGTTNCYD GNLWSKDLCP SSDTCSQKCY IEGADYSGTY GIQSSSGSKLT LKFVTKGSYS TNIGSRVYLL KDENTYESFK LKNKEFTFTV DDSKLNCGLN GALYFVAMDA DGGKAKYSSF KPGAKYGMGY CDAQCPHDMK FISGKANVDD WKPQDNDENS GNGKLGTCCS EMDIWEGNMK SQAYTVHACT KSGQYECTGQ QCGDTDSGDR FKGTCDKDGC DYASWRGDQ SFYGEGKTVD TKQPVTVVTQ FIGDPLTEIR RLYVQGGKTI NNSKTSNLAD TYDSITDKFC DATKEASGDT NDFKAKGAMS GFSTNLNNGQ VLVMSLWDDH TANMLWLDST YPTDSSDSTA QRGPCPTSSG VPKDVESQHG DATVVFSDIK FGAINSTFKY N |
| SEQ ID NO: 118 | MLAAALFTFA CSVGVGTKTP ENHPKLNWQN CASKGSCSQV SGEVTMDSNW RWTHDGNGKN CYDGNTWISS LCPDDKTCSD KCVLDGAEYQ ATYGIQSNGT ALTLKFVTHG SYSTNIGSRL YLLKDKSTYY VFKLNNKEFT FSVDVSKLPC GLNGALYFVE MDADGGKAKY AGAKPGAEYG LGYCDAQCPS DLKFINGEAN SEGWKPQSGD KNAGNGKYGS CCSEMDVWES NSQATALTPH VCKTTGQQRC SGKSECGGQD GQDRFAGLCD EDGCDFNNWR MGDKTFPGPG LIVDTKSPFV VVTQFYGSPV TEIRRKYVQN GKVIENSKSN IPGIDATAAI SDHFCEQQKK AFGDTNDFKN KGGFAKLGQV FDRGMVLVLS LWDDHQVAML WLDSTYPTNK DKSQPGVDRG PCPTSSGKPD DVESASADAT VVYGNIKFGA LDSTY |
| SEQ ID NO: 119 | MLTLVFFLLS LVVSLEIGTQ QSEDHPKLTW IVLDSNWRWV HDSGTTNCYD GNLWSKDLCP SSNTCSQKCY IEGADYSGTY GIQSSSGSKLT LKFVTKGSYS TNIGSRVYLL KDENTYESFK LKNKEFTFTV DDSKLNCGLN GALYFVAMDA DGGKAKYSSF KPGAKYGMGY CDAQCPHDMK FISGKANVDD WKPQDNDENS GNGKLGTCCS EMDIWEGNMK SQAYTVHACT KSGQYECTGQ QCGDTDSGDR FKGTCDKDGC DYASWRGDQ SFYGEGKTVD TKQPVTVVTQ FIGDPLTEIR RLYVQGGKTI NNSKTSNLAD TYDSITDKFC DATKEASGDT NDFKAKGAMS TANMLWLDST YPTDSTKTGA SRGPCAVSSG VPKDVESQYG DATVIYSDIK FGAINSTFKW N GFSTNLNNGQ VLVMSLWDDH |
| SEQ ID NO: 120 | MILALLSLAK SLGIATNQAE THPKLTWTRY QSKGSGQTVN GEIVLDSNWR KLKNKEFTFT VDDSKLPCGL NGALYFVAMD EDGGVSKNSI DLDGADYPGT YGISTSGNSL KLGFVTHGSY STNIGSRVYL LRDSKNYEMF LRDSKNYEMF TEMDIWEANS MATAYTPHVC TVTGLRRCEG KVNIAGITAG RYNGICDKDG YCDAQCPHDM KFINGEANVL DWKPQSNDEN SGNGRYGACC QFVTSNGQDS GTLSEIRRKY VQGGKVIENS ERGACATSSG APSDVESQSP DATVTFSDIK NKAGAQYGTG QKKAFGDNND CDFNSYRLGD KTFFGVGKTV SKQLDAGMVL VLSLWDDHSV NMLWLDSTYP TNAAAGALGT FGPIDSTY FEKKGGLGAL |
| SEQ ID NO: 121 | MLVIALILRG LSVGTGTQQS ETHPSLSWQQ TSKGGSGQSV VYLLGDESHY KLFKLENNEF TFTVDDSNLE CGLNGALYFV NCYDGNEWSS DLCPDASTCS SNCVLEGADY SGTYGITGSG SSLKLGFVTK GSYSTNIGSR NVEGWKPSDN DENAGTGKWG ACCTEMDIWE ANKYATAYTP HICTKNGEYR CEGTDCGDTK AMDEDGGASK YSGAKPGAKY DNNRYGGVCD GMGYCDAQCP HDMKFINGDA KDGCDFNSWR MGNQSFEVGK TVTQFLADGG SLSEIRRKYV QGGKVIENTV KISGMDEFD SITDEFCNQQ KKAFRDTNDF EKKGGLKGLG TAVDAGVLV LSLWDDHDVN MLWLDSIYPT DSGSKAGADR GPCATSSGVP KDVESNYASA SVTFSDIKFG PIDSTY |
| SEQ ID NO: 122 | MLLALFAFGK SLGIATNQAE NHPKLTWTRY QSKGSGQTVN GEIVLDSNWR WTHHSGTNCY VDDSKLPCGL NGALYFVAMD EDGGVSKNSI DLDGADYPGT YGISSSGNSL KLGFVTHGSY STNIGSRVYL LRDSKNYEMF KLKNKEFTFT TEMDIWEANS MATAYTPHVC TVTGIRRCEG KVNIAGMAAG NSITDTFCNE NKAGAQYGTG QKKAFGDNND YCDAQCPHDM KFINGEANVL DWKPQSNDEN SGNGRYGACC QFVTSNGQDS GTLSEIRRKY VQGGKVIENS APSDVESQSP DATVTFSDIK FGPIDSTY CDFNSYRLGD KSFFGVGKTV NMLWLDSTYP ERGACATSSG VLSLWDDHSV TNAAAGALGT |
| SEQ ID NO: 123 | MLASVVLVS LVVSLEIGTQ QSEEHPKLTW IVLDSNWRWL HDSGTTNCYD GNLWSDDLCP NADTCSSKCY IEGADYSGTY GITSSSGSKVT LKFVTKGSYS TNIGSRIYLL KDENTYETFK LKNKEFTFTV DDSKLDCGLN GALYFVAMDA DGGKAKYSSF KPGAKYGMGY CDAQCPHDMK FISGKANVDD WKPQNDENS GDGKLGTCCS EMDIWEGNAK SQAYTVHACS KSGQYECTGQ QCGDTDSGDR FKGTCDKDGC DYASWRWGDQ SFYGEGKTVD TKSPVTVVTQ FIGDPLTEIR RVYVQGGKTI NNKITSNLAD TYDSITDKFC DATKDATGDT NDFKAKGAMA GFSTNLNTAQ VLVSVHCGMI IQPICCGLIR RIQIQQKQV QAVDRVLCRR VFQRMLKASM VMLQSRTRTL SLELSTRPLV GISPAGRLFF F |

TABLE 7-continued

| SEQ ID NO. | Amino acid sequence |
|---|---|
| SEQ ID NO: 124 | MILALLVLGK SLGIATNQAE THPKLTWTRY QSKGSGSTVN GEIVLDSNWR WTHHSGTNCY PDTTCSNNC DLDGADYPGT YGISTSGNSL KLGFVTHGSY STNIGSRVYL LKDTKSYEMF KLKNKEFTFT VDDSKLPCGL NGALYFVAMD EDGGVSKNSI NKAGAQYGTG YCDAQCPHDM KFINGEANVL DWKPQSNDEN SGNGRYGACC TEMDIWEANS MATAYTPHVC TVTGLRRCEG TECGDTDNDQ RYNGICDKDG CDFNSYRLGD KSFFGVGKTV DSSKPVTVVT QFVTSNGQDS GTLSEIRRKY VQGGKVIENS KVNVAGITAG NSVDTFFCNE QKKAFGDNND FEKKGGLGAL SKQLDAGMVL VLSLWDDHSV NMLWLDSTYP TNAAAGALGT ERGACATSSG KPSDVESQSP DATVTFSDIK FGPIDSTY |
| SEQ ID NO: 125 | MLCIGLISFV YSLGVGTNTA ETHPKLTWKN GGQTVNGEVT VDSNWRWTHT KGSTKNCYDG NLWSKDLCPD AATCGKNCVL EGADYSGTYG VTSSGNALTL KFVTHGSYST NVGSRLYLLK DEKTYQMFNL NGKEFTFTVD VSNLPCGLNG ALYHVNMDED GGTKRYPDNE AGAKYGTGYC DAQCPTDLKF INGIPNSDGW KPQSNDKNSG NGKYGSCCSE MDIWEANSIC SAVTPHVCDN LQQTRCQGTA CGENGGGSRF GSSCDPDGCD FNSWRMGNKT FYGPGLIVDT KSKFTVVTQF VGNPVTEIKR KVYQNGKVIE NSYSNIEGMD KFNSVSDKFC TAQKKAFGDT DSFTKHGGFK QLGSALAKGM VLVLSLWDDH TVNMLWLDSV YPTNSKKAGS DRGPCPTTSG VPADVESKSA DANVIYSDIR FGAIDSTYK |
| SEQ ID NO: 126 | MLGALVALAS CIGVGTNTPE KHPDLKWTNG GSSVSGSIVV DSNWRWTHIK GETKNCYDGN LWSDKYCPDA ATCGKNCVLE GADYSGTYGV TTSGDAATLK FVTHGQYSTN VGSRLYLLKD EKTYQMFNLV GKEFTFTVDV SNLPCGLNGA LYFVQMDSDG GMAKYPDNQA GAKYGTGYCD AQCPTDLKFI NGIPNSDGWK PQKNDKNSGN GKYGSCCSEM DIWEANSMAT AYTPHVCDKL EQTRCSGSAC GQNGGGDRFS SSCDPDGCDF NSWRMGNKTF WGPGLIVDTK KPVQVTPEIK KVYQGGKVI DNSMTNIAAM SKQYNSVSDE FCQAQKKAFG DNDSFTKHGG FRQLGATLSK GHVLVLSLWD DHDVNMLWLD SVYPTNSNKP GADRGPCKTS SGVPSDVESQ NADSTVKYSD IRFGAIDSTY SK |
| SEQ ID NO: 127 | MLAAALFTFA CSVGVGTKTT ETHPKLNWQQ CACKGSCSQV SGEVTMDSNW RWTHDGNGKN CYDGNTWISS LCPDDKTCSD KCVLDGAEYQ ATYGIQSNGT ALTPKFVTHG SYSTNIGSRL YLLKDKSTYY VFQLNNKEFT FSVDVSKLPC GLNGALYFVE MDADGGKSKY AGAKPGAEYG LGYCDAQCPS DLKFINGEAN SEGWKPQSGD KNAGNGKYGS VVTQFYGSPV TEIRRKVQN NSMATALTPH VCKTTGQTRC SGKSECGGQD GQDRFAGNCD EDGCDFNNWR MGDKTFFGPG LTVDTKSPFV VVTQFYGSPV TEIRRKVQN DKSVPGVDRG PCPTSSGKPD DVESASGDAT VVYGNIKFGA LDSTY KGGFTKLGSV FSRGMVLVLS LWDDHQVAML WLDSTYPINK |
| SEQ ID NO: 128 | MFGFLLSLFA LQFALEIGTQ TSESHPSITW ELNGARQSGQ IVIDSNWRWL HDSGTTNCYD GNTWSSDLCP DPEKCSQNCY LEGADYSGTY GISASGSQLT LGFVTKGSYS TNIGSRVYLL KDENTYPMFK LKNKEFTFTV DVSNLPCGLN GALYFVAMPS DGGKAKYPLA KPGAKYGMGY CDAQCPHDMK FINGEANVLD WKPQSNDENA GTGRYGTCCT EMDIWEANSQ ATAYTYHACS KNARCEGTEC GDDSASQRYN GICDKDGCDF NSWRMGNKTF FGPGLTVDSS KPVTVVTQFI GDPLTEIRRI WVQGGKVIQN SFTNVSGITS VDSINTFCD ESKVATGDTIN DFKAKGGMSG FSKALDTEVV LVLSLWDDHT ANMLWLDSTY PTDSTAIGAS RGPCATSSGD PKDVESASAN ASVKFSDIKF GALDSTY |
| SEQ ID NO: 129 | MLASLLPLSN SLGTASNQAE THPKLTWTQY TGKGAGQTVN GEIVLDSNWR WTHKDGTNCY VDDSKLPCGL NGAVYFVAMD PDTTCSNNC NLDGADYPGT YGITTSGNQL KLGFVTHGSY STNIGSRVYL LRDSKNYQMF KLKNKEFTFT VDDSKLPCGL NGAVYFVAMD EDGGTAKHSI NKAGAQYGTG YCDAQCPHDM KFINGEANVL DWKPQSNDEN SGNGRWGARC TEMDIWEANS RATAYTPHIC TKTGLYRCEG TECGDSDTNR YGGVCDKDGC DFNSYRMGDK SFFGQGKTVD SSKPVTVVTQ FITDNNQDSG KLTEIRRKYV QGGKVIDNSK VNIAGITAGN PITDTFCDEA KKAFGDNNDF GPIDSTY EKKGGLSALG TQLEAGFVLV LSLWDDHSVN MLWLDSTYPT NASPGALGVE RGDCAITSGV PADVESQSAD ASVTFSDIKF |
| SEQ ID NO: 130 | MLCIGLISFV YSLGVGTNTA ETHPKLTWKN GGQTVNGEVT VDSNWRWTHT KGSTKNCYDG NLWSKDLCPD AATCGKNCVL EGADYSGTYG VTSSGNALTL KFVTHGSYST NVGSRLYLLK DEKTYQMFNL NGKEFTFTVD VSNLPCGLSG ALYHVNMDED GGTKRYPDNE AGAKYGTGYC DAQCPHDMK FINGIPNSDGW KPQSNDKNSG NGKYGSCCSE MDIWEANSIC SAVTPHVCDN LQQTRCQGAA CGENGGGSRF GSSCDPDGCD FNSWGMGNKT FYGPGLIVDT KSKFTVVTQF VGNPVTEIKR KVYQNGKVIE NSYSNIEGMD KFNSVSDKFC TAQKKAFGDT DSFTKHGGFK QLGSALAKGM VLVLSLWDDH TVNMLWLDSV YPTNSKKAGS DRGPCPTTSG VPADVESKSA DANVIYSDIR FGAIDSTYK |
| SEQ ID NO: 131 | MILALLVLGK SLGIATNQAE THPKLTWTRY QSKGSGSTVN GEIVLDSNWR WTHHSGTNCY PDTTCSNNC DLDGADYPGT YGISTSGNSL KLGFVTHGSY STNIGSRVYL LRDSKNYEMF KLKNKEFTFT VDDSKLPCGL NGALYFVAMD EDGGVSKNSI NKAGAQYGTG YCDAQCPHDM KFINGEANVL DWKPQSNDEN SGNGRYGACC TEMDIWEANS MATAYTPHVC TVTGLRRCEG TECGDTDNDQ RYNGICDKDG CDFNSYRLGD KSFFGVGKTV DSSKPVTVVT QFVTSNGQDS GILSETRRKY VQGGKVIENS KVNVAGITAG NSVDTFFCNE QKKAFGDNND FGPIDSTY VLSLWDDHSV NMLWLDSTYP TNAAAGALGT ERGACATSSG KPSDVESQSP DATVTFSDIK |
| SEQ ID NO: 132 | MIGIVLIQTV FGIGVGTQQS ESHPSLSWQQ CSKGGSCTSV SGSIVLDSNW RWTHIPDGTT NCYDGNEWSS DLCPDPTTCS NNCVLEGADY SGTYGISTSG SSAKLGFVTK SSAKLGFVTK GSYSTNIGSR VYLLGDESHY KIFDLKNKEF TFTVDDSNLE CGLNGALYFV AMDEDGGASR FTLAKPGAKY FEKKGGLGAL SKQLDAGMVL |

TABLE 7-continued

| SEQ ID NO. | Amino acid sequence |
|---|---|
| SEQ ID NO: 133 | GTGYCDAQCP HDIKFINGEA NVQDMKPSDN DDNAGTGHYG ACCTEMDIWE ANKYATAYTP HICTENGEYR CEGKSCGDSS DDRYGGVCDK DGCDFNSWRL GNQSFWGPGL IIDTGKPVTV VTQFVTKDGT DSGALSEIRR KYVQGGKTIE NTVVKLSGID EVDSITDEFC NQQKQAFGDT NDFEKKGGLS GLGKAPDYGV VLVLSLWDDH DVNMLWLDSV YPTNPAGKAG ADRGPCATSS GDPKEVEDKY ASASVTFSDI KFGPIDSTY |
| SEQ ID NO: 134 | MLVFGIVSFV YSIGVGTNTA ETHPKLTWKN GGSTTNGEVT VDSNWRTHT KGSTKNCYDG NLWSKDLCPD AATCGKNCVL EGADYSGTYG VTSSGDALTL KFVTHGSYST NVGSRLYLLK DEKTYQMFNL NGKEFTFTVD VSQLPCGLNG ALYFVCMDQD GGMSRYPDNQ AGAKYGTYC DAQCPTDLKF INGLPNSDGW KPQSNDKNSG NGKYGSCCSE MDIWEANSLA TAVTPHVCDQ VGQTRCEGRA CGENGGGDRF GSICDPDGCD FNSWRMGNKT FWGPGLIIDT KKPVTVVTQF IGSPVTEIKR EYVQGGKVIE NSYTNIEGMD KFNSLSDKFC TAQKKAFGDN DSFTKHGGFS KLGQSFTKGQ VLVLSLWDDH TVNMLWLDSV YPTNSKKLGS DRGPCPTSSG VPADVESKNA DSSVKYSDIR FGSIDSTYK |
| SEQ ID NO: 135 | MLSFVFLLGF GVSLEIGTQQ SENHPTLSWQ QCTSSGSCTS QSGSIVLDSN WRWVHDSGTT NCYDGNEWSS DLCPDPETCS KNCYLDGADY SGTYGITSNG SSLKLGFVTE GSYSTNIGSR VYLKKDTNTY QIFKLKNHEF TFTVDVSNLP CGLNGALYFV EMEADGGKGK YPLAKPGAQY GMGYCDAQCP HDMKFINGNA NVLDMKPQET DENSGNRYG TCCTEMDIWE ANSQATAYTP HICTKDGQYQ CEGTECGCSD ANQRYNGVCD KDGCDFNSYR LGNKTPFGPG LIVDSKKPVT VTQFITSNG QDSGDLTEIR RIYVQGGKTI QNSFTNIAGL TSVDSITEAF CDESKDLFGD TNDFKAKGGF TAMGKSLDTG VVLVLSLWDD HSVNMLWLDS TYPTDAAAGA LGTQRGPCAT SSGAPSDVES QSPDASVTFS DIKFGPLDST Y |
| SEQ ID NO: 135 | MLTLVVYLLS LVVSLEIGTQ QSESHPALTW QREGSSASGS IVLDSNWRWV LKNKEFTFTV HDSGTTNCYD DDSKLLDCGLN GALYFVAMDA SSDTCTQKCY IEGADYSGTY GITTSGSKLT LKFVTKGSYS TNIGSRVYLL KDENTYETFK EMDIWEGNAK SQAYTVHACT KSGQYECTGT DCGDSDSRYQ DGGKAKYGMGY KPGAKYGMGY CDAQCPHDMK FISGKANVED WKPQDNDENS GNGKLGTCCS YIQGGKVINN SKTQNLASVY DSITDAFCDA TKAASGDTND GTCKDKDGCD ASYRWGDHSF YGEGKTVDTK QPITVVTQFI GDPLTEIRRL GPCATSSGVP KDVESNQADA SVVFSDIKFG AINSTYSYN FRAKGAMAGF SKNLDTPQVL VLSLWDDHTA NMLWLDSTYP TDSRDATAER |
| SEQ ID NO: 136 | MFGFLLSLFA LQFALEIGTQ TSESHPSITW ELNGARQSGQ IVIDSNWRWL LKNKEFTFTV HDSGTTNCYD DVSNLPCGLN GALYFVAMPS DPEKCSQNCY LEGADYSGTY GISASGSQLT LGFVTKGSYS TNIGSRVYLL KDENTYQMFK KDENTYETFK EMDIWEANSQ ATAYTVHACS KNARCEGTEC GDDSASQRYN DGGKAKYPLA KPGAKYGMGY CDAQCPHDMK FINGEANVLD WKPQSNDENA GTGRYGTCCT GDPLTEIRRI WQGGKVIQN SFTNVSGITS VDSITNTFCD ESKVATGDTN GICDKDGCDF NSWRMGNKTF FGPGLTVDSS KPVTVVTQFI RGPCATSSGD PKNVESASAN ASVKFSDIKF GAFDSTY DFKAKGGMSG FSKALDTEVV LVLSLWDDHT ANMLWLDSTY PSNSTAIGAT |
| SEQ ID NO: 137 | MLALVIFLLS LVVSLEIGTQ QSEDHPKLTW QNGSSSVGGS IVLDSNWRWV LKNKEFTFTV HDSGTTNCYD DDSQLNCGLN GALYFVAMDA SSDTCTSKCY IEGADYSGTY GITTSGSKLT LKFVTKGSYS TNIGSRIYLL KDENTYETFK EMDIWEGNAK SQAYTVHACT NNSKTSNLAD TYDSITDKFC DGGKAKYSSF FKGTCDKDGC KPGAKYGMGY CDAQCPHDMK FISGKANVDD WKPQDNDENS GNGKLGTCCS FIGDPLTEIR RLYVQGGKTI SRGPCAVTSG VPKDVESQYG SAQVVYSDIK QCGDTDSGDR DATKEASGDT FGAINSTY NDFKAKGAMS DYASWRWGDQ SFYGEGKTVD VLVLSLWDDH TKQPVTVVTQ YPTDSTKTGA GFSTNLNTAQ TANMLWLDST |
| SEQ ID NO: 138 | MLALVIFLLS FVVSLEIGTQ QSEDHPKLTW QNGSSSVSGS IVLDSNWRWV LKGKEFTFTV HDSGTTNCYD DDSKLLDCGLN GALYFVAMDA SSDTCSSKCY IEGADYSGTY GISASGSKLT LKFVTKGSYS TNIGSRVYLL KDENTYETFK EMDIWEGNAK SQAYTVHACT NNSKTSNLAN VYDSITDKFC DGGKAKYSSF FKGTCDKDGC KPGAKYGMGY CDAQCPHDMK FISGKANVDD WKPQDNDENS GNGKLGTCCS FIGDPLTEIR RYVVQGGKTI SRGPCAVLSG VPKNVESQHG DATVIYSDIK QCGDTDSGDR DDTKDATGDT FGAINSTFSY NDFKAKGAMS DYASWRWGDQ SFYGEGKTVD VLVMSLWDDH TKQPVTVVTQ YPTDSTKTGA N GFSTNLNTAQ TANMLWLDST |
| SEQ ID NO: 139 | MFLALFVLGK SLGIATNQAE NHPKLTWTRY QSKGSGQTVN GEVVLDSNWR WTHHSGTNCY VDDSKLPCGL NGALYFVAME PDPQTCSSNC DLDGADYPGT YGISSSGNSL KLGFVTHGSY STNIGSRVYL LRDSKNYEMF KLKNKEFTFT IEMDIWEANS MATAYTPHVC TVTGIHRCEG EDGVAKNSI TECGDTDANQ NIKAGAQYGTG YCDAQCPHDM KFINGEANVL DWKPQSNDEN SGNGRYGACC GTLSEIKRKY VQGGKVIENS KVNIAGITAV KPSDVESQSP RYNGICDKDG QKKAFGDNND CDFNSRYMGD KSFFGVGKTV DSSKPVTVVT QFVTSNGQDG NMLWLDSTYP TDAAAGALGT ERGACATSSG DASVTFSDIK FGPIDSTY FEKKGGLGAL SKQLDIGMVL |
| SEQ ID NO: 140 | MLLCLLSIAN SLGVGTNTAE NHPKLSWKNG GSSVSGSVTV DANMRWTHIK GETKNCYDGN LMSDKYCPDA ATCGKNCVIE GADYQGTYGV SSSGDGLTLT FVTHGQYSTN VGSRLYLMKD EKTYQMFNLN GKEFTFTVDV DIWEANSQAT SNLPCGLNGA LYFVQMDSDG GMAKYPDNQA GAKYGTGYCD AQCPTDLKFI NGIPNSDGWK PQKNDKNSGN GKYGSCCCSEM DIWEANSQAT AYTPHVCDKL EQTRCSGSSC GHTGGGERFS SSCDPDGCDF NSWRMGNKTF WGPGLIVDTK KPVQVVTQFV GSGNSCTEIK RKYVQGGKVI DNSMSNIAGM SKQINSVSDD FCQAQKKAFG DNDSFTKHGG FRQLGATLGK GHVLVLSLWD DHDVNMLWLD SVYPTNSNKP GSDRGPCKTS SGIPADVESQ AASSSVKYSD IRFGAIDSTY K |

TABLE 7-continued

| SEQ ID NO. | Amino acid sequence |
|---|---|
| SEQ ID NO: 141 | MLCIGLISFV YSLGVGTNTA ETHPKLTWKN GGQTVNGEVT VDSNWRTHT KGSTKNCYDG NLWSKDLCPD AATCGKNCVL EGADYSGTYG VTSSGNALTL KFVTHGSYST NVGSRLYLMK DEKTYQMFNL NGKEFTFTVD VSNLPCGLNG ALYHVNMDED GGTKRYPDNE AGAKYGTGYC DAQCPTDLKF INGIPNSDGW KPQSNDKNSG NGKYGSCCSE MDIWEANSIC SAVTPHVCDT LQQTRCQGTA CGENGGGSRF GSSCDPDGCD FNSWRMGNKT FYGPGLIVDT KSKFTVVTQF VGSPVTEIKR KYVQNGKVIE NSFSNIEGMD KFNSISDKFC TAQKKAFGDT DSFTKHGGFK QLGSALAKGM VLVLSLWDDH TVNMLWLDSV YPTNSKKAGS DRGPCPTTSG VPADVESKSA NANVIYSDIR FGAIDSTYK |
| SEQ ID NO: 142 | MLLCLLLGIAS SLDAGTNTAE NHPQLSWKNG GSSVSGSVTV DANWRWTHIK GETKNCYDGN LWSDKYCPDA ATCGNCVIE GADYQGTYGV SASGNALTLT FVTHGQYSTN VGSRLYLLKD EKTYQIFNLI GKEFTFTVDV SNLPCGLNGA LYFVQMDADG GTAKYSDNKA GAKYGTGYCD AQCPTDLKFI NGIPNSDGWK PQKNDKNSGN GRYGSCCSEM DVWEANSLAT AYTPHVCDKL EQVRCDGRAC GQNGGGDRFS SSCCDPDGCF NSWRLGNKTF WGPGLIVDTK QPVQVVTQWV GGSTSVTEIK RKYVQGGKVI DNSFTKLDSL TKQYNSVSDE FCVAQKKAFG DNDSFTKHGG FRQLGATLAK GHVLVLSLWD DHDVNMLWLD SVYPTNSNKP GADRGPCKTS SGVPADVESQ AASSSVKYSD IRFGAIDSTY K |
| SEQ ID NO: 143 | MLGIGFVCIV YSLGVGTNTA ENHPKLTWKN SGSTTNGEVT VDSNWRWTHT KGTTKNCYDG NLWSKDLCPD AATCGKNCVL EGADYSGTYG VTSSGDALTL KFVTHGSYST NVGSRLYLLK DEKTYQIFNL NGKEFTFTVD VSNLPCGLNG ALYFVNMDAD GGTGRYPDNQ AGAKYGTGYC DAQCPTDLKF INGIPNSDGW KPQSNDKNSG NGKYGSCCSE MDIWEANSLA TAVTPHVCDQ VGQTRCEGRA CGENGGGDRF GSSCDPDGCD FNSWRLGNKT FWGPGLIVDT KKPVTVTQF VGSPVTEIKR KYVQNGKVIE NSYTNIEGLD KFNSISDKFC TAQKKAFGDN DSFIKHGGFR QLGQSFTKGQ VLVLSLWDDH TVNMLWLDSV YPTNSKKPGA DRGPCPTSSG VPADVESKNA GSSVKYSDIR FGSIDSTYK |
| SEQ ID NO: 144 | MATLVGILVS LFALEVALEI GTQTSESHPS LSWELNGQRQ RWLHDSGTTN CYDGNEWSSD LCPDPEKCSQ NCYLEGADYS GTYGISSSGN SLQLGFVTKG SYSTNIGSRV YLLKDENTYA TFKLKNKEFT FTADVSNLPC GLNGALYFVA MPADGGKSKY PLAKPGAKYG MGYCDAQCPH DMKFINGEAN ILDWKPSSND ENAGAGRYGT CCTEMDIWEA NSQATAYTVH ACSKNARCEG TECGDDDGRY NGICDKDGCD FNSWRMGNKT FFGPNLIVDS SKPVTVTQP IGDPLTEIRR IYVQGGKVIQ NSFTNISGVA SVDSITDAFC NENKVATGDT NDFKAKGGMS GFSKALDTEV VLVLSLWDDH TANMLWLDST YPTDSSALGA SRGPCAITSG EPKDVESASA NASVKFSDIK FGAIDSTY |
| SEQ ID NO: 145 | MLTLVYPLLS LVVSLEIGTQ QSESHPQLSW QNGSSSVSGS IVLDSNWRWV HDSGTTNCYD GNLWSTDLCP SSDTCTSKCY IEGADYSGTY GITSSGSKLT LKFVTKGSYS TNIGSRVYLL KDENTYETFK LKNKEFTFTV DDSKLLDCGLN GALYFVAMDA DGGKAKYSSF KPGAKYGMGY CDAQCPHDMK FISGKANVDD WKPQDNDENS GNGKLGTCCS EMDIWEGNAK SQAYTVHACT KSGQYECTGQ QCGDTDSGDR FKGTCDKDGC DYASMRWGDQ SFYGEGKTVD TKQPLTVVTQ FVGDPLTEIR RVYVQGGKTI NNSKITSNLAD TYDSITDKFC DATKEASGDT NDFKAKGAMS GFSTNLNTAQ VLVMSLWDDH TANMLWLDST YPTDSTKTGA SRGPCAVSSG VPKDVESQHG DATVIYSDIK FGAINSTFKM N |
| SEQ ID NO: 146 | MLSLVSIFLV GLGFSLGVGT QQSESHPSLS WQNCSAKGSC QSVSGSIVLD SNWRWLHDSG TTNCYDGNEW STDLCPDAST CDKNCYIEGA DYSGTYGITS SGAQLKLGFV TKGSYSTNIG SRVYLLRDES HYQLFKLKNH EFTFTVDDSQ LPCGLNGALY FVEMAEDGGA KPGAQYGMGY CDAQCPHDMK FITGEANVKD WKPQETDENA GNGHYGACCT EMDIWEANSQ ATAYTPHICS KTGIYRCEGT ECGNDNANQR YNGVCDKDGC DFNSYRLGNK TFWGPGLITVD SNKAMIVVTQ FTTSNNQDSG ELSEIRRIYV QGGKTIQNSD TNVQGITTTN KITQAFCDET KVTFGDTNDF KAKGGFSGLS KSLESGAVLV LSLWDDHSVN MLWLDSTYPT DSAGKPGADR GPCAITSGDP KDVESQSPNA SVTFSDIKFG PIDSTY |
| SEQ ID NO: 147 | MILALLVLGK SLGIATNQAE THPKLTWTRY QSKGSGSTVN GEIVLDSNWR WTHHSGTNCY DGNTWSTSLC PDPTTCSNNC DLDGADYPGT YGISTSGNSL KLGFVTHGSY STNIGSRVYL LKDTKSYEMF KLKNKEFTFT VDDSKLPCGL NGALYFVAMD MATAYTPHVC TVTGLRRCEG TECGDTDNDQ EDGGVSKNSI NKAGAQYGTG YCDAQCPHDM KFINGEANVL DWKPQSNDEN SGNGRYGACC TEMDIWEANS MATAYTPHVC VQGGKVIENS KVNVAGITAG RYNGICDKDG CDFNSYRLGD KSFFGVGKTV DSSKPVTVVT QFVTSNGQDS GTLSEIRRKY KPSDVESQSP DATVIFSDIK QKKAFGDNND FEKKGGFGAL SKQLVAGMVL VLSLWDDHSV NMLWLDSTYP TNAAAGALGT ERGACATSSG KPSDVESQSP DATVIFSDIK FGPIDSTY |
| SEQ ID NO: 148 | MLCVGLFGLV YSIGVGTNTQ ETHPKLSWKQ CSSGGSCTTQ QGSSVIDSNW RWTHSTKDLT NCYDGNLWDS TLCPDGTTCS KNCVLEGADY GADYQGTYGV SGTYGITSSG DSLTLKFVTH NGSTNVGSR LYLLKDDNNY QIFNLAGKEF TFTVDVSNLP CGLNGALYFV EMDQDGGKGK HKENEAGAKY GTGYCDAQCP TDLKFIDGIA NSDGWKPQDN DENSGNGKYG SCCSEMDIWE ANSLATAYTP HVCDRKGQKR CQGTACGENG GGDRFGSECD PDGCDFNSWR QGNKSFWGPG LIIDTKKSVQ VVTQFIGSGS VTEIRRKYV QNGKVIENSY STISGTEKYN SISDDYCNAQ KRAFGDTNSF ENHGGFKRFS QHIQDMVLVL SLWDDHTVNM LWLDSVYPTN SNKPGADRGP CETSSGVPAD VESKSASASV KYSDIRFGPI DSTYK |
| SEQ ID NO: 149 | MLLCLMSIAY SLGVGTNTAE NHPKLSWKNG GSSVSGSVTV DANWRWTHIK GETKNCYDGN LWSDKYCPDA ATCGKNCVIE GADYQGTYGV SASGDGLTLT FVTHGQYSTN VGSRLYLMKD EKTYQIFNLN GKEFTFTVDV SNLPCGLNGA LYFVQMDSDG GMAKYPDNQA GAKYGTGYCD |

TABLE 7-continued

| SEQ ID NO. | Amino acid sequence |
|---|---|
| | AQCPTDLKFI NGIPNSDGWK PQKNDKNSGN GKYGSCCSEM DIWEANSQAT AYTPHVCDKL EQTRCSGSAC GHTGGGERFS SSCDPDGCDF NSWRMGNKTF WGPGLIVDTK KPVQVVTQFV GSGNSCTEIK RKYVQGGKVI DNSMSNIAGM TKQYNSVSDD FCQAQKAFG DNDSFTKHGG FRQLGATLGK GHVLVLSLWD DHDVNMLWLD SVVPTNSNKP GSDRGPCKTS SGIPADVESQ AASSSVKYSD IRFGAIDSTY K |
| SEQ ID NO: 299 | QSACTLQSET HPPLTWQKCS SGGTCTQQTG SVVIDANWRW THATNSSTNC YDGNTWSSTL CPDNETCAKN CCLLDGAAYAS TYGVTTSGNS LSIGFVTQSA QKNVGARLYL MASDTTYQEF TLLGNEFSFD VDVSQLPCGL NGALYFVSMD ADGGVSKYPT NTAGAKYGTG YCDSQCPRDL KFINGQANVE GWEPSSNNAN TGIGGHGSCC SEMDIWEANS ISEALTPHPC TTVGQEICEG DGCGGTYSDN AYGGTCDPDG CDWNPYRLGN TSFYGPGSSF TLDTIKKLTV VTQFETSGAI NRYYVQNGVT FQQPNAELGS YSGNELNDDY CTAEEAEFGG SSFSDKGGLT QFKKATSGGM VLVMSLWDDY YANMLWLDST YPTNETSSTP GAVRGSCSTS SGVPAQVESQ SPNAKVTFSN IKFGPIGSTG NPSGGNPPGG NPPGTTTTRR PATTTGSSPG PTQSHYGQCG GIGYSGPTVC ASGTTCQVLN PYYSQCL |
| SEQ ID NO: 300 | QSACTLQSET HPPLTWQKCS SGGTCTQQTG SVVIDANWRW THATNSSTNC YDGNTWSSTL CPDNETCAKN CCLLDGAAYAS TYGVTTSGNS LSIGFVTQSA QKNVGARLYL MASDTTYQEF TLLGNEFSFD VDVSQLPCGL NGALYFVSMD ADGGVSKYPT NTAGAKYGTG YCDSQCPRDL KFINGQANVE GWEPSSNNAN TGIGGHGSCC SEMDIWEANS ISEALTPHPC TTVGQEICEG DGCGGTYSDN RYGGTCDPDG CDWNPYRLGN TSFYGPGSSF TLDTIKKLTV VTQFETSGAI NRYYVQNGVT FQQPNAELGS YSGNELNDDY CTAEEAEFGG SSFSDKGGLT QFKKATSGGM VLVMSLWDDY YANMLWLDST YPTNETSSTP GAVAGSCSTS SGVPAQVESQ SPNAKVTFSN IKFGPIGSTG NPSGGNPPGG NPPGTTTTRR PATTTGSSPG PTQSHYGQCG GIGYSGPTVC ASGTTCQVLN PYYSQCL |
| SEQ ID NO: 301 | MSALNSFNMY KSALILGSLL ATAGAQQIGT YTAETHPSLS WSTCKSGGSC TTNSGAITLD ANWRWVHGVN TSTNCYTGNT WNTAICDTDA SCAQDCALDG ADYSGTYGIT TSGNSLRLNF VTGSNVGSRT YLMADNTHYQ IFDLLNQEFT FTVDVSHLPC GLNGALYFVT MDADGGVSKY PNNKAGAQYG VGYCDSQCPR DLKFIAGQAN VEGWTPSSNN ANTGLGNHGA CCAELDIWEA NSISEALTPH PCDTPGLSVC TTDACGGTYS SDKYAGTCDP DGCDFNPYRL GVTDFYGSGK TVDTTKPITV VTQFVTDDGT STGTLSEIRR YVVQNGVVIP QPSSKISGVS GNVINSDFCD AEISTRFGETA SFSKHGGLAK MGAGMEAGMV LVMSLWDDYS VNMLWLDSTY PTNATGTPGA AKGSCPTTSG SSYVTFSDIR VGPFNSTFSG GSSTGGSSTT TASGTTTTKA SSTSTSTST GTGVAAHWGQ CGGQGWTGPT TCASGTTCTV VNPYYSQCL |
| SEQ ID NO: 302 | QQIGTYTAET HPSLSWSTCK SGGSCTTNSG AITLDANWRW VHGVNTSTNC YTGNTWNTAI CDTDASCAQD CALDGADYSG TYGITTSGNS LRLNFVTGSN VGSRTYLMAD NTHYQIFDLL NQEFTFTVDV SHLPCGLNGA LYFVTMDADG GVSKYPNNKA GAQYGVGYCD SQCPRDLKFI AGQANVEGWT PSSNNANTGL GNHGACCAEL DIWEANSISE ALTPHPCDTP GLSVCTTDAC GGTYSSDKYA GTCDPDGCDF NPYRLGVTDF YGSGKIVDTT KPITVVTQFV TDDGTSTGTL SEIRRYVVQN GVVIPQPSSK ISGVSGNVIN SDFCDAEIST FGETASFSKH GGLAKMGAGM EAGMVLVMSL WDDYSVNMLW LDSTYPTNAT GTPGAAKGSC PTTSGDPKTV ESQSGSSYVT FSDIRVGPFN STFSGGSSTG GSSTTTASGT TTTKASSTST SSTSTGTGVA AHWGQCGGQG WTGPTTCASG TTCTVVNPYY SQCL |

SEQUENCE LISTING (302 sequences)

SEQ ID NO: 1 - protein, 529 aa, Unknown
  source: /note="Description of Unknown: Variant CBH I polypeptide sequence"
MSALNSFNMYKSALILGSLLATAGAQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSSNNANTGLGNHGACCAELDIWEANSISEALTPHPCDTPGLSVCTTDACGGTYSSDRYAGTCDPDGCDFNPYRLGVTDFYGSGKTVDTTKPITVVTQFVTDDGTSTGTLSEIRRYYVQNGVVIPQPSSKISGVSGNVINSDFCDAEISTFGETASFSKHGGLAKMGAGMEAGMVLVMSLWDDYSVNMLWLDSTYPTNATGTPGAARGSCPTTSGDPKTVESQSGSSYVTFSDIRVGPFNSTFSGGSSTGGSSTTTASGTTTTKASSTSTSSTSTGTGVAAHWGQCGGQGWTGPTTCASGTTCTVVNPYYSQCL

SEQ ID NO: 2 - protein, 514 aa, Trichoderma reesei
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 3 - protein, 529 aa, Penicillium occitanis
MSALNSFNMYKSALILGSLLATAGAQQIGTYTAETHPSLSWSTCKSGGSCTTNSGAITLDANWRWVHGVNTSTNCYTGNTWNSAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSANNANTGIGNHGACCAELDIWEANSISEALTPHPCDTPGLSVCTTDACGGTYSSDRYAGTCDPDGCDFNPYRLGVTDFYGSGKTVDTTKPFTVVTQFVTNDGTSTGSLSEIRRYYVQNGVVIPQPSSKISGISGNVINSDYCAAEISTFGGTASFNKHGGLTNMAAGMEAGMVLVMSLWDDYAVNMLWLDSTYPTNATGTPGAARGTCATTSGDPKTVESQSGSSYVTFSDIRVGPFNSTFSGGSSTGGSTTTTASRTTTTSASSTSTSSTSTGTGVAGHWGQCGGQGWTGPTTCVSGTTCTVVNPYYSQCL

SEQ ID NO: 4 - protein, 434 aa, Trichoderma reesei
ESACTLQSETHPPLTWQKCSSGGTCTQQTGSVVIDANWRWTHATNSSTNCYDGNTWSSTLCPDNETCAKNCCLDGAAYASTYGVTTSGNSLSIDFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWQANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 5 - protein, 526 aa, Aspergillus nidulans
MASSFQLYKALLFFSSLLSAVQAQKVGTQQAEVHPGLTWQTCTSSGSCTTVNGEVTIDANWRWLHTVNGYTNCYTGNEWDTSICTSNEVCAEQCAVDGANYASTYGITTSGSSLRLNFVTQSQQKNIGSRVYLMDDEDTYTMFYLLNKEFTFDVDVSELPCGLNGAVYFVSMDADGGKSRYATNEAGAKYGTGYCDSQCPRDLKFINGVANVEGWESSDTNPNGGVGNHGSCCAEMDIWEANSISTAFTPHPCDTPGQTLCTGDSCGGTYSNDRYGGTCDPDGCDFNSYRQGNKTFYGPGLTVDTNSPVTVVTQFLTDDNTDTGTLSEIKRFYVQNGVVIPNSESTYPANPGNSITTEFCESQKELFGDVDVFSAHGGMAGMGAALEQGMVLVLSLWDDNYSNMLWLDSNYPTDADPTQPGIARGTCPTDSGVPSEVEAQYPNAYVVYSNIKFGPIGSTFGNGGGSGPTTTVTTSTATSTTSSATSTATGQAQHWEQCGGNGWTGPTVCASPWACTVVNSWYSQCL

SEQ ID NO: 6 - protein, 512 aa, Gibberella zeae
MYRAIATASALIAAVRAQQVCSLTQESKPSLNWSKCTSSGCSNVKGSVTIDANWRWTHQVSGSTNCYTGNKWDTSVCTSGKVCAEKCCLDGADYASTYGITSSGDQLSLSFVTKGPYSTNIGSRTYLMEDENTYQMFQLLGNEFTFDVDVSNIGCGLNGALYFVSMDADGGKAKYPGNKAGAKYGTGYCDAQCPRDVKFINGQANSDGWQPSDSDVNGGIGNLGTCCPEMDIWEANSISTAYTPHPCTKLTQHSCTGDSCGGTYSNDRYGGTCDADGCDFNSYRQGNKTFYGPGSGFNVDTTKKVTVVTQFHKGSNGRLSEITRLYVQNGKVIANSESKIAGVPGNSLTADFCTKQKKVFNDPDDFTKKGAWSGMSDALEAPMVLVMSLWHDHHSNMLWLDSTYPTDSTKLGSQRGSCSTSSGVPADLEKNVPNSKVAFSNIKFGPIGSTYKSDGTTPTNPTNPSEPSNTANPNPGTVDQWGQCGGSNYSGPTACKSGFTCKKINDFYSQCQ

SEQ ID NO: 7 - protein, 532 aa, Aspergillus fumigatus
MLASTFSYRMYKTALILAALLGSGQAQQVGTSQAEVHPSMTWQSCTAGGSCTTNNGKVVIDANWRWVHKVGDYTNCYTGNTWDTTICPDDATCASNCALEGANYESTYGVTASGNSLRLNFVTTSQQKNIGSRLYMMKDDSTYEMFKLLNQEFTFDVDVSNLPCGLNGALYFVAMDADGGMSKYPTNKAGAKYGTGYCDSQCPRDLKFINGQANVEGWQPSSNDANAGTGNHGSCCAEMDIWEANSISTAFTPHPCDTPGQVMCTGDACGGTYSSDRYGGTCDPDGCDFNSFRQGNKTFYGPGMTVDTKSKFTVVTQFITDDGTSSGTLKEIKRFYVQNGKVIPNSESTWTGVSGNSITTEYCTAQKSLFQDQNVFEKHGGLEGMGAALAQGMVLVMSLWDDHSANMLWLDSNYPTTASSTTPGVARGTCDISSGVPADVEANHPDAYVVYSNIKVGPIGSTFNSGGSNPGGGTTTTTTTQPTTTTTTAGNPGGTGVAQHYGQCGGIGWTGPTTCASPYTCQKLNDYYSQCL

SEQ ID NO: 8 - protein, 539 aa, Aspergillus clavatus
MLPSTISYRIYKNALFFAALFGAVQAQKVGTSKAEVHPSMAWQTCAADGTCTTKNGKVVIDANWRWVHDVKGYTNCYTGNTWNAELCPDNESCAENCALEGADYAATYGATTSGNALSLKFVTQSQQKNIGSRLYMMKDDNTYETFKLLNQEFTFDVDVSNLPCGLNGALYFVSMDADGGLSRYTGNEAGAKYGTGYCDSQCPRDLKFINGLANVEGWTPSSSDANAGNGGHGSCCAEMDIWEANSISTAYTPHPCDTPGQAMCNGDSCGGTYSSDRYGGTCDPDGCDFNSYRQGNKSFYGPGMTVDTKKKMTVVTQFLTNDGTATGTLSEIKRFYVQDGKVIANSESTWPNLGGNSLTNDFCKAQKTVFGDMDTFSKHGGMEGMGAALAEGMVLVMSLWDDHNSNMLWLDSNSPTTGTSTTPGVARGSCDISSGDPKDLEANHPDASVVYSNIKVGPIGSTFNSGGSNPGGSTTTTKPATSTTTTKATTTATTNTTGPTGTGVAQPWAQCGGIGYSGPTQCAAPYTCTKQNDYYSQCL

SEQ ID NO: 9 - protein, 456 aa, Claviceps purpurea
MHPSLQTILLSALFTTAHAQQACSSKPETHPPLSWSRCSRSGCRSVQGAVTVDANWLWTTVDGSQNCYTGNRWDTSICSSEKTCSESCCIDGADYAGTYGVTTTGDALSLKFVQQGPYSKNVGSRLYLMKDESRYEMFTLLGNEFTFDVDVSKLGCGLNGALYFVSMDEDGGMKRFPMNKAGAKFGTGYCDSQCPRDVKFINGMANSKDWIPSKSDANAGIGSLGACCREMDIWEANNIASAFTPHPCKNSAYHSCTGDGCGGTYSKNRYSGDCDPDGCDFNSYRLGNTTFYGPGPKFTIDTTRKISVVTQFLKGRDGSLREIKRFYVQNGKVIPNSVSRVRGVPGNSITQGFCNAQKKMFGAHESFNAKGGMKGMSAAVSKPMVLVMSLWDDHNSNMLWLDSTYPTNSRQRGSKRGSCPASSGRPTDVESSAPDSTVVFSNIKFGPIGSTFSRGK

SEQ ID NO: 10 - protein, 434 aa, Phanerochaete chrysosporium; identical to SEQ ID NO: 4

SEQ ID NO: 11 - protein, 452 aa, Neosartorya fischeri
MHQRALLFSALAVAANAQQVGTQKPETHPPLTWQKCTAAGSCSQQSGSVVIDANWRWLHSTKDTTNCYTGNTWNTELCPDNESCAQNCAVDGADYAGTYGVTTSGSELKLSFVTGANVGSRLYLMQDDETYQHFNLLNNEFTFDVDVSNLPCGLNGALYFVAMDADGGMSKYPSNKAGAKYGTGYCDSQCPRDLKFINGMANVEGWKPSSNDKNAGVGGHGSCCPEMDIWEANSISTAVTPHPCDDVSQTMCSGDACGGTYSATRYAGTCDPDGCDFNPFRMGNESFYGPGKIVDTKSEMTVVTQFITADGTDTGALSEIKRLYVQNGKVIANSVSNVADVSGNSISSDFCTAQKKAFGDEDIFAKHGGLSGMGKALSEMVLIMSIWDDHHSSMMWLDSTYPTDADPSKPGVARGTCEHGAGDPEKVESQHPDASVTFSNIKFGPIGSTYKA

SEQ ID NO: 12 - protein, 438 aa, Leptosphaeria maculans
MYRSLIFATSLLSLAKGQLVGNLYCKGSCTAKNGKVVIDANWRWLHVKGGYTNCYTGNEWNATACPDNKSCATNCAIDGADYRRLRHYCERQLLGTEVHHQGLYSTNIGSRTYLMQDDSTYQLFKFTGSQEFTFDVDLSNLPCGLNGALYFVSMDADGGLKKYPTNKAGAKYGTGYCDAQCPRDLKFINGEGNVEGWQPSKNDQNAGVGGHGSCCAEMDIWEANSVSTAVTPHSCSTIEQSRCDGDGCGGTYSADRYAGVCDPDGCDFNSYRMGVKDFYGKGKTVDTSKKFTVVTQFIGSGDAMEIKRFYVQNGKTIPQPDSTIPGVTGNSITTFFCDAQKKAFGDKYTFKDKGGMANMPSTCNGMVLVMSLWDDHYSNMLWLDSTYPTDKNPDTDAGSGRGECAITSGVPADVESQHPDASVIYSNIKFGPINTTFG

SEQ ID NO: 13 - protein, 521 aa, Neurospora crassa
MLAKFAALAALVASANAQAVCSLTAETHPSLNWSKCTSSGCTNVAGSITVDANWRWTHITSGSTNCYSGNEWDTSLCSTNTDCATKCCVDGAEYSSTYGIQTSGNSLSLQFVTKGSYSTNIGSRTYLMNGADAYQGFELLGNEFTFDVDVSGTGCGLNGALYFVSMDLDGGKAKYTNNKAGAKYGTGYCDAQCPRDLKYINGIANVEGWTPSTNDANAGIGDHGTCCSEMDIWEANKVSTAFTPHPCTTIEQHMCEGDSCGGTYSDDRYGGTCDADGCDFNSYRMGNTTFYGEGKTVDTSSKFTVVTQFIKDSAGDLAEIKRFYVQNGKVIENSQSNVDGVSGNSITQSFCNAQKTAFGDIDDFNKKGGLKQMGKALAKPMVLVMSIWDDHAANMLWLDSTYPVEGGPGAYRGECPTTSGVPAEVEANAPNSKVIFSNIKFGPIGSTFSGGSSGTPPSNPSSSVKPVTSTAKPSSTSTASNPSGTGAAHWAQCGGIGFSGPTTCQSPYTCQKINDYYSQCV

SEQ ID NO: 14 - protein, 460 aa, Coprinopsis cinerea
MFKKVALTALCFLAVAQAQQVGREVAENHPRLPWQRCTRNGGCQTVSNGQVVLDANWRWLHVTDGYTNCYTGNSWNSTVCSDPTTCAQRCALEGANYQQTYGITTNGDALTIKFLTRSQQTNVGARVYLMENENRYQMFNLLNKEFTFDVDVSKVPCGINGALYFIQMDADGGMSKQPNNRAGAKYGTGYCDSQCPRDIKFIDGVANSADWTPSETDPNAGRGRYGICCAEMDIWEANSISNAYTPHPCRTQNDGGYQRCEGRDCNQPRYEGLCDPDGCDYNPFRMGNKDFYGPGKTVDTNRKMTVVTQFITHDNTDTGTLVDIRRLYVQDGRVIANPPTNFPGLMPAHDSITEQFCTDQKNLFGDYSSFARDGGLAHMGRSLAKGHVLALSIWNDHGAHMLWLDSNYPTDADPNKPGIARGTCPTTGGTPRETEQNHPDAQVIFSNIKFGDIGSTFSGY

SEQ ID NO: 15 - protein, 599 aa, Botryotinia fuckeliana
MYSAAVLATFSFLLGAGAQQVGTSTAETHPALTVQKCAAGGTCTDESDSIVLDANWRWLHSTSGSTNCYTGNTWDTTLCPDAATCTTNCALDGADYEGTYGITTSGDSLKLSFVTGSNVGSRTYLMDSETTYKEFALLGNEFTFTVDVSKLPCGLNGALYFVPMDADGGMSKYPTNKAGAKYGTGYCDAQCPQDMKFVNGTANVEGWVPDSNSANSGTGNIGSCCSEFDVWEANSMSQALTPHVCTVDSQTACTGDDCASNTGVCDGDGCDFNPYRMGNTTFYGSGMTIDTSKPFSVVTQFITDDGTETGTLTEIKRFYVQDDVVYEQPSSDISGVSGNSITDDFCAAQKTAFGDTDYFTQNGGMAAMGKKMADGMVLVLSIWDDYNVNMLWLDSDYPTTKDASTPGVSRGSCATDSGVPATVEAASGSAYVTFSSIKYGPIGSTFNAPADSSSSVSASSSPAPIASSSSSASIAPVSSVVAAIVSSSAQAISSAAPVVSSSAQAISSAAPVVSSVVSSAAPVATSSTKSKCSKVSSTLKTSVAAPATSATSAAVVATSSAASSTGSVPLYGNCTGGKTCSEGTCVVQNDYYSQCVASS

SEQ ID NO: 16 - protein, 433 aa, Phaeosphaeria nodorum
MTWQRCTGTGGSSCTNVNGEIVIDANWRWIHATGGYTNCFDGNEWNKTACPSNAACTKNCAIEGSDYRGTYGITTSGNSLTLKFITKGQYSTNVGSRTYLMKDTNNYEMFNLIGNEFTFDVDLSQLPCGLNGALYFVSMPEKGQGTPGAKYGTGKLSQCSVHISKTLTDACARDLKFVGGEANADGWQASTSDPNAGVGKKGACCAEMDVWEANSMSTALTPHSCQPEGYAVCEESNCGGTYSLDRYAGTCDANGCDFNPYRVGNKDFYGKGKTVDTSKKMTVVTQFLGTGSDLTELKRFYVQDGKVISNPEPTIPGMTGNSITQKWCDTQKEVFKEEVYPFNQWGGMASMGKGMAQGMVLVMSLWDDHYSNMLWLDSTYPTDRDPESPGAARGECAITSGAPAEVEANNPDASVMFSNIKFGPIGSTFQQPA

SEQ ID NO: 17 - protein, 451 aa, Humicola grisea
MQIKSYIQYLAAALPLLSSVAAQQAGTITAENHPRMTWKRCSGPGNCQTVQGEVVIDANWRWLHNNGQNCYEGNKWTSQCSSATDCAQRCALDGANYQSTYGASTSGDSLTLKFVTKHEYGTNIGSRFYLMANQNKYQMFTLMNNEFAFDVDLSKVECGINSALYFVAMEEDGGMASYPSNRAGAKYGTGYCDAQCARDLKFIGGKANIEGWRPSTNDPNAGVGPMGACCAEIDVWESNAYAYAFTPHACGSKNRYHICETNNCGGTYSDDRFAGYCDANGCDYNPYRMGNKDFYGKGKTVDTNRKFTVVSRFERNRLSQFFVQDGRKIEVPPPTWPGLPNSADITPELCDAQFRVFDDRNRFAETGGFDALNEALTIPMVLVMSIWDDHHSNMLWLDSSYPPEKAGLPGGDRGPCPTTSGVPAEVEAQYPNAQVVWSNIRFGPIGSTVNV

SEQ ID NO: 18 - protein, 525 aa, Humicola grisea
MRTAKFATLAALVASAAAQQACSLTTERHPSLSWKKCTAGGQCQTVQASITLDSNWRWTHQVSGSTNCYTGNKWDTSICTDAKSCAQNCCVDGADYTSTYGITTNGDSLSLKFVTKGQYSTNVGSRTYLMDGEDKYQTFELLGNEFTFDVDVSNIGCGLNGALYFVSMDADGGLSRYPGNKAGAKYGTGYCDAQCPRDIKFINGEANIEGWTGSTNDPNAGAGRYGTCCSEMDIWEANNMATAFTPHPCTIIGQSRCEGDSCGGTYSNERYAGVCDPDGCDFNSYRQGNKTFYGKGMTVDTTKKITVVTQFLKDANGDLGEIKRFYVQDGKIIPNSESTIPGVEGNSITQDWCDRQKVAFGDIDDFNRKGGMKQMGKALAGPMVLVMSIWDDHASNMLWLDSTFPVDAAGKPGAERGACPTTSGVPAEVEAEAPNSNVVFSNIRFGPIGSTVAGLPGAGNGGNNGGNPPPPTTTTSSAPATTTTASAGPKAGRWQQCGGIGFTGPTQCEEPYTCTKLNDWYSQCL

SEQ ID NO: 19 - protein, 451 aa, Chaetomium thermophilum
MQIKQYLQYLAAALPLVNMAAAQRAGTQQTETHPRLSWKRCSSGGNCQTVNAEIVIDANWRWLHDSNYQNCYDGNRWTSACSSATDCAQKCYLEGANYGSTYGVSTSGDALTLKFVTKHEYGTNIGSRVYLMNGSDKYQMFTLMNNEFAFDVDLSKVECGLNSALYFVAMEEDGGMRSYSSNKAGAKYGTGYCDAQCARDLKFVGGKANIEGWRPSTNDANAGVGPYGACCAEIDVWESNAYAFAFTPHGCLNNNYHVCETSNCGGTYSEDRFGGLCDANGCDYNPYRMGNKDFYGKGKTVDTSRKFTVVTRFEENKLTQFFIQDGRKIDIPPPTWPGLPNSSAITPELCTNLSKVFDDRDRYEETGGFRTINEALRIPMVLVMSIWDGHYANMLWLDSVYPPEKAGQPGAERGPCAPTSGVPAEVEAQFPNAQVIWSNIRFGPIGSTYQV

SEQ ID NO: 20 - protein, 530 aa, Chaetomium thermophilum
MMYKKFAALAALVAGAAAQQACSLTTETHPRLTWKRCTSGGNCSTVNGAVTIDANWRWTHTVSGSTNCYTGNEWDTSICSDGKSCAQTCCVDGADYSSTYGITTSGDSLNLKFVTKHQHGTNVGSRVYLMENDTKYQMFELLGNEFTFDVDVSNLGCGLNGALYFVSMDADGGMSKYSGNKAGAKYGTGYCDAQCPRDLKFINGEANIENWTPSTNDANAGFGRYGSCCSEMDIWDANNMATAFTPHPCTIIGQSRCEGNSCGGTYSSERYAGVCDPDGCDFNAYRQGDKTFYGKGMTVDTTKKMTVVTQFHKNSAGVLSEIKRFYVQDGKIIANAESKIPGNPGNSITQEWCDAQKVAFGDIDDFNRKGGMAQMSKALEGPMVLVMSVWDDHYANMLWLDSTYPIDKAGTPGAERGACPTTSGVPAEIEAQVPNSNVIFSNIRFGPIGSTVPGLDGSTPSNPTATVAPPTSTTTSVRSSTTQISTPTSQPGGCTTQKWGQCGGIGYTGCTNCVAGTTCTELNPWYSQCL

SEQ ID NO: 21 - protein, 419 aa, Phaeosphaeria nodorum
MYRNFLYAASLLSVARSQLVGTQTTETHPGMTWQSCTAKGSCTTCSDNKACASNCAVDGADYKGTYGITASGNSLQLKFITKGSYSTNIGSRTYLMASDTAYQMFKFDGNKEFTFDVDLSGLPCGFNGALYFVSMDEDGGLKKYSGNKAGAKYGTGYCDAQCPRDLKFINGEGNVEGWKPSDNDANAGVGGHGSCCAEMDIWEANSISTAVTPHACSTIEQTRCDGDGCGGTYSADRYAGVCDPDGCDFNAYRMGVKNFYGKGMTVDTSKKFTVVTQFIGTGDAMEIKRFYVQGGKTIEQPASTIPGVEGNSITTKFCDQQKQVFGDRYTYKEKGGTANMAKALAQGMVLVMSLWDDHYSNMLWLDSTYPTDKNPDTDLGSGRGSCDVKSGAPADVESKSPDATVIYSNIKFGPLNSTY

SEQ ID NO: 22 - protein, 460 aa, Coprinopsis cinerea
MLGKIAIASLSFLAIAKGQQVGREVAENHPRLPWQRCTRNGGCQTVSNGQVVLDANWRWLHVTDGYTNCYTGNSWNSSVCSDGTTCAQRCALEGANYQQTYGITTSGNSLTMKFLTRSQGTNVGGRVYLMENENRYQMFNLLNKEFTFDVDVSKVPCGINGALYFIQMDADGGMSSQPNNRAGAKYGTGYCDSQCPRDIKFIDGVANSVGWEPSETDSNAGRGRYGICCAEMDIWEANSISNAYTPHPCRTQNDGGYQRCEGRDCNQPRYEGLCDPDGCDYNPFRMGNKDFYGPGKTIDTNRKMTVVTQFITHDNTDTGTLVDIRRLYVQDGRVIANPPTNFPGLMPAHDSITEQFCTDQKNLFGDYSSFARDGGLAHMGRSLAKGHVLALSIWNDHGAHMLWLDSNYPTDADPNKPGIARGTCPTTGGTPRETEQNHPDAQVIFSNIKFGDIGSTFSGY

SEQ ID NO: 23 - protein, 506 aa, Agaricus bisporus
MFPRSILLALSLTAVALGQQVGTNMAENHPSLTWQRCTSSGCQNVNGKVTLDANWRWTHRINDFTNCYTGNEWDTSICPDGVTCAENCALDGADYAGTYGVTSSGTALTLKFVTESQQKNIGSRLYLMADDSNYEIFNLLNKEFTFDVDVSKLPCGLNGALYFSEMAADGGMSSTNTAGAKYGTGYCDSQCPRDIKFIDGEANSEGWEGSPNDVNAGTGNFGACCGEMDIWEANSISSAYTPHPCREPGLQRCEGNTCSVNDRYATECDPDGCDFNSFRMGDKSFYGPGMTVDTNQPITVVTQFITDNGSDNGNLQEIRRIYVQNGQVIQNSNVNIPGIDSGNSISAEFCDQAKEAFGDERSFQDRGGLSGMGSALDRGMVLVLSIWDDHAVNMLWLDSDYPLDASPSQPGISRGTCSRDSGKPEDVEANAGGVQVVYSNIKFGDINSTFNNNGGGGGNPSPTTTRPNSPAQTMWGQCGGQGWTGPTACQSPSTCHVINDFYSQCF

SEQ ID NO: 24 - protein, 454 aa, Phaeosphaeria nodorum
MYRNLALASLSLFGAARAQQAGTVTTETHPSLSWKTCTGTGGTSCTTKAGKITLDANWRWTHVTTGYTNCYDGNSWNTTACPDGATCTKNCAVDGADYSGTYGITTSSNSLSIKFVTKGSNSANIGSRTYLMESDTKYQMFNLIGQEFTFDVDVSKLPCGLNGALYFVEMAADGGIGKGNNKAGAKYGTGYCDSQCPHDIKFINGKANVEGWNPSDADPNAGSGKIGACCPEMDIWEANSISTAYTPHPCKGTGLQECTDDVSCGDGSNRYSGLCDKDGCDFNSYRMGVKDFYGPGATLDTTKKMTVVTQFLGSGSTLSEIKRFYVQNGKVFKNSDSAIEGVTGNSITESFCAAQKTAFGDTNSFKTLGGLNEMGASLARGHVLVMSLWDDHAVNMLWLDSTYPTNSTKLGAQRGTCAIDSGKPEDVEKNHPDATVVFSDIKFGPIGSTFQQPS

SEQ ID NO: 25 - protein, 449 aa, Phanerochaete chrysosporium
MVDIQIATFLLLGVVGVAAQQVGTYIPENHPLLATQSCTASGGCTTSSSKIVLDANRRWIHSTLGTTSCLTANGWDPTLCPDGITCANYCALDGVSYSSTYGITTSGSALRLQFVTGTNIGSRVFLMADDTHYRTFQLLNQELAFDVDVSKLPCGLNGALYFVAMDADGGKSKYPGNRAGAKYGTGYCDSQCPRDVQFINGQANVQGWNATSATTGTGSYGSCCTELDIWEANSNAAALTPHTCTNNAQTRCSGSNCTSNTGFCDADGCDFNSFRLGNTTFLGAGMSVDTTKTFTVVTQFITSDNTSTGNLTEIRRFYVQNGNVIPNSVVNVTGIGAVNSITDPFCSQQKKAFIETNYFAQHGGLAQLGQALRTGMVLAFSISDDPANHMLWLDSNFPPSANPAVPGVARGMCSITSGNPADVGILNPSPYVSFLNIKFGSIGTTFRPA

SEQ ID NO: 26 - protein, 452 aa, Aspergillus fumigatus
MHQRALLFSALAVAANAQQVGTQTPETHPPLTWQKCTAAGSCSQQSGSVVIDANWRWLHSTKDTTNCYTGNTWNTELCPDNESCAQNCALDGADYAGTYGVTTSGSELKLSFVTGANVGSRLYLMQDDETYQHFNLLNHEFTFDVDVSNLPCGLNGALYFVAMDADGGMSKYPSNKAGAKYGTGYCDSQCPRDLKFINGMANVEGWEPSSSDKNAGVGGHGSCCPEMDIWEANSISTAVTPHPCDDVSQTMCSGDACGGTYSESRYAGTCDPDGCDFNPFRMGNESFYGPGKIVDTKSKMTVVTQFITADGTDSGALSEIKRLYVQNGKVIANSVSNVAGVSGNSITSDFCTAQKKAFGDEDIFAKHGGLSGMGKALSEMVLIMSIWDDHHSSMMWLDSTYPTDADPSKPGVARGTCEHGAGDPENVESQHPDASVTFSNIKFGPIGSTYEG

SEQ ID NO: 27 - protein, 516 aa, Phanerochaete chrysosporium
MFRTATLLAFTMAAMVFGQQVGTNTAENHRTLTSQKCTKSGGCSNLNTKIVLDANWRWLHSTSGYTNCYTGNQWDATLCPDGKTCAANCALDGADYTGTYGITASGSSLKLQFVTGSNVGSRVYLMADDTHYQMFQLLNQEFTFDVDMSNLPCGLNGALYLSAMDADGGMAKYPTNKAGAKYGTGYCDSQCPRDIKFINGEANVEGWNATSANAGTGNYGTCCTEMDIWEANNDAAAYTPHPCTTNAQTRCSGSDCTRDTGLCDADGCDFNSFRMGDQTFLGKGLTVDTSKPFTVVTQFITNDGTSAGTLTEIRRLYVQNGKVIQNSSVKIPGIDPVNSITDNFCSQQKTAFGDTNYFAQHGGLKQVGEALRTGMVLALSIWDDYAANMLWLDSNYPTNKDPSTPGVARGTCATTSGVPAQIEAQSPNAYVVFSNIKFGDLNTTYTGTVSSSSVSSSHSSTSTSSSHSSSSTPPTQPTGVTVPQWGQCGGIGYTGSTTCASPYTCHVLNPYYSQCY

SEQ ID NO: 28 - protein, 457 aa, Thermoascus aurantiacus
MYQRALLFSFFLAAARAHEAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGNLSKYPGNKAGAKYGTGYCDSQCPRDLKFINGQANVEGWQPSANDPNAGVGNHGSSCAEMDVWEANSISTAVTPHPCDTPGQTMCQGDDCGGTYSSTRYAGTCDPDGCDFNPYQPGNHSFYGPGKIVDTSSKFTVVTQFITDDGTPSGTLTEIKRFYVQNGKVIPQSESTISGVTGNSITTEYCTAQKAAFGDNTGFFTHGGLQKISQALAQGMVLVMSLWDDHAANMLWLDSTYPTDADPDTPGVARGTCPTTSGVPADVESQNPNSYVIYSNIKVGPINSTFTAN

SEQ ID NO: 29 - protein, 451 aa, Humicola grisea
MQIKSYIQYLAAALPLLSSVAAQQAGTITAENHPRMTWKRCSGPGNCQTVQGEVVIDANWRWLHNNGQNCYEGNKWTSQCSSATDCAQRCALDGANYQSTYGASTSGDSLTLKFVTKHEYGTNIGSRFYLMANQNKYQMFTLMNNEFAFDVDLSKVECGINSALYFVAMEEDGGMASYPSNRAGAKYGTGYCDAQCARDLKFIGGKANIEGWRPSTNDPNAGVGPMGACCAEIDVWESNAYAYAFTPHACGSKNRYHICETNNCGGTYSDDRFAGYCDANGCDYNPYRMGNKDFYGKGKTVDTNRKFTVVSRFERNRLSQFFVQDGRKIEVPPPTWPGLPNSADITPELCDAQFRVFDDRNRFAETGGFDALNEALTIPMVLVMSIWDDHHSNMLWLDSSYPPEKAGLPGGDRGPCPTTSGVPAEVEAQYPDAQVVWSNIRFGPIGSTVNV

SEQ ID NO: 30 - protein, 514 aa, Trichoderma viride
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWDPYRLGNTSFYGPGSSFTLDTTKKLTVVTQFETSGAINRYYVQNGVTFQQPNAELGSYSGNGLNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGDPSGGNPPGGNPPGTTTTRRPATTTGSSPGPTQSHYGQCGGIGYSGPTVCASGTTCQVLNPYYSQCL

SEQ ID NO: 31 - protein, 457 aa, Thermoascus aurantiacus
MYQRALLFSFFLAAARAQQAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGGLSKYPGNKAGAKYGTGYCDSQCPRDLKFINGQANVEGWQPSANDPNAGVGNHGSCCAEMDVWEANSISTAVTPHPCDTPGQTMCQGDDCGGTYSSTRYAGTCDPDGCDFNPYRQGNHSFYGPGQIVDTSSKFTVVTQFITDDGTPSGTLTEIKRFYVQNGKVIPQSESTISGVTGNSITTEYCTAQKAAFGDNTGFFTHGGLQKISQALAQGMVLVMSLWDDHAANMLWLDSTYPTDADPDTPGVARGTCPTTSGVPADVESQYPNSYVIYSNIKVGPINSTFTAN

SEQ ID NO: 32 - protein, 453 aa, Magnaporthe grisea
MIRKITTLAALVGVVRGQAACSLTAETHPSLTWQKCSSGGSCTNVAGSVTIDANWRWTHTTSGYTNCYTGNKWDTSICSTNADCASKCCVDGANYQQTYGASTSGNALSLQYVTQSSGKNVGSRLYLLESENKYQMFNLLGNEFTFDVDASKLGCGLNGAVYFVSMDADGGQSKYSGNKAGAKYGTGYCDSQCPRDLKYINGAANVEGWQPSSGDANSGVGNMGSCCAEMDIWEANSISTAYTPHPCSNNAQHSCKGDDCGGTYSSVRYAGDCDPDGCDFNSYRQGNRTFYGPGSNFNVDSSKKVTVVTQFISSGGQLTDIKRFYVQNGKVIPNSQSTITGVTGNSVTQDYCDKQKTAFGDQNVFNQRGGLRQMGDALAKGMVLVMSVWDDHHSQMLWLDSTYPTTSTAPGAARGSCSTSSGKPSDVQSQTPGATVVYSNIKFGPIGSTFKSS

SEQ ID NO: 33 - protein, 455 aa, Talaromyces emersonii
MLRRALLLSSSAILAVKAQQAGTATAENHPPLTWQECTAPGSCTTQNGAVVLDANWRWVHDVNGYTNCYTGNTWDPTYCPDDETCAQNCALDGADYEGTYGVTSSGSSLKLNFVTGSNVGSRLYLLQDDSTYQIFKLLNREFSFDVDVSNLPCGLNGALYFVAMDADGGVSKYPNNKAGAKYGTGYCDSQCPRDLKFIDGEANVEGWQPSSNNANTGIGDHGSCCAEMDVWEANSISNAVTPHPCDTPGQTMCSGDDCGGTYSNDRYAGTCDPDGCDFNPYRMGNTSFYGPGKIIDTTKPFTVVTQFLTDDGTDTGTLSEIKRFYIQNSNVIPQPNSDISGVTGNSITTEFCTAQKQAFGDTDDFSQHGGLAKMGAAMQQGMVLVMSLWDDYAAQMLWLDSDYPTDADPTTPGIARGTCPTDSGVPSDVESQSPNSYVTYSNIKFGPINSTFTAS

SEQ ID NO: 34 - protein, 454 aa, Aspergillus oryzae
MHQRALLFSAFWTAVQAQQAGTLTAETHPSLTWQKCAAGGTCTEQKGSVVLDSNWRWLHSVDGSTNCYTGNTWDATLCPDNESCASNCALDGADYEGTYGVTTSGDALTLQFVTGANIGSRLYLMADDDESYQTFNLLNNEFTFDVDASKLPCGLNGAVYFVSMDADGGVAKYSTNKAGAKYGTGYCDSQCPRDLKFINGQVRKGWEPSDSDKNAGVGGHGSCCPQMDIWEANSISTAYTPHPCDDTAQTMCEGDTCGGTYSSERYAGTCDPDGCDFNAYRMGNESFYGPSKLVDSSSPVTVVTQFITADGTDSGALSEIKRFYVQGGKVIANAASNVDGVTGNSITADFCTAQKKAFGDDDIFAQHGGLQGMGNALSSMVLTLSIWDDHHSSMMWLDSSYPEDADATAPGVARGTCEPHAGDPEKVESQSGSATVTYSNIKYGPIGSTFDAPA

SEQ ID NO: 35 - protein, 529 aa, Penicillium chrysogenum
MASTLSFKIYKNALLLAAFLGAAQAQQVGTSTAEVHPSLTWQKCTAGGSCTSQSGKVVIDSNWRWVHNTGGYTNCYTGNDWDRTLCPDDVTCATNCALDGADYKGTYGVTASGSSLRLNFVTQASQKNIGSRLYLMADDSKYEMFQLLNQEFTFDVDVSNLPCGLNGALYFVAMDEDGGMARYPTNKAGAKYGTGYCDAQCPRDLKFINGQANVEGWEPSSSDVNGGTGNYGSCCAEMDIWEANSISTAFTPHPCDDPAQTRCTGDSCGGTYSSDRYGGTCDPDGCDFNPYRMGNQSFYGPSKIVDTESPFTVVTQFITNDGTSTGTLSEIKRFYVQNGKVIPQSVSTISAVTGNSITDSFCSAQKTAFKDTDVFAKHGGMAGMGAGLAEGMVLVMSLWDDHAANMLWLDSTYPTSASSTTPGAARGSCDISSGEPSDVEANHSNAYVVYSNIKVGPLGSTFGSTDSGSGTTTTKVTTTTATKTTTTTGPSTTGAAHYAQCGGQNWTGPTTCASPYTCQRQGDYYSQCL

SEQ ID NO: 36 - protein, 528 aa, Podospora anserina
MVSAKFAALAALVASASAQQVCSLTPESHPPLTWQRCSAGGSCTNVAGSVTLDSNWRWTHTLQGSTNCYSGNEWDTSICTTGTKCAQNCCVEGAEYAATYGITTSGNQLNLKFVTEGKYSTNVGSRTYLMENATKYQGFNLLGNEFTFDVDVSNIGCGLNGALYFVSMDLDGGLAKYSGNKAGAKYGTGYCDAQCPRDIKFINGEANIEGWNPSTNDVNAGAGRYGTCCSEMDIWEANNMATAYTPHSCTILDQSRCEGESCGGTYSSDRYGGVCDPDGCDFNSYRMGNKEFYGKGKTVDTTKKMTVVTQFLKNAAGELSEIKRFYVQNGVVIPNSVSSIPGVPNQNSITQDWCDAQKIAFGDPDDNTAKGGLRQMGLALDKPMVLVMSIWNDHAAHMLWLDSTYPVDAAGRPGAERGACPTTSGVPSEVEAEAPNSNVAFSNIKFGPIGSTFNSGSTNPNPISSSTATTPTSTRVSSTSTAAQTPTSAPGGTVPRWGQCGGQGYTGPTQCVAPYTCVVSNQWYSQCL

SEQ ID NO: 37 - protein, 458 aa, Pleurotus sp.
MFPYIALVSFSFLSVVLAQQVGTLTAETHPQLTVQQCTRGGSCTTQQRSVVLDGNWRWLHSTSGSNNCYTGNTWDTSLCPDAATCSRNCALDGADYSGTYGITSSGNALTLKFVTHGPYSTNIGSRVYLLADDSHYQMFNLKNKEFTFDVDVSQLPCGLNGALYFSQMDADGGTGRFPNNKAGAKYGTGYCDSQCPHDIKFINGEANVQGWQPSPNDSNAGKGQYGSCCAEMDIWEANSMASAYTPHPCTVTTPTRCQGNDCGDGDNRYGGVCDKDGCDFNSFRMGDKNFLGPGKTVNTNSKFTVVTQFLTSDNTTSGTLSEIRRLYVQNGRVIQNSKVNIPGMASTLDSITESFCSTQKTVFGDTNSFASKGGLRAMGNAFDKGMVLVLSIWDDHEAKMLWLDSNYPLDKSASAPGVARGTCATTSGEPKDVESQSPNAQVIFSNIKYGDIGSTYSN

SEQ ID NO: 38 - protein, 512 aa, Gibberella zeae
MYRAIATASALIAAVRAQQVCSLTQESKPSLNWSKCTSSGCSNVKGSVTIDANWRWTHQVSGSTNCYTGNKWDTSVCTSGKVCAERCCLDGADYASTYGITSSGDQLSLSFVTKGPYSTNIGSRTYLMEDENTYQMFQLLGNEFTFDVDVSNIGCGLNGALYFVSMDADGGKAKYPGNKAGAKYGTGYCDAQCPRDVKFINGQANSDGWQPSDSDVNGGIGNLGTCCPEMDIWEANSISTAYTPHPCTKLTQHSCTGDSCGGTYSNDRYGGTCDADGCDFNSYRQGNKTFYGPGSGFNVDTTKKVTVVTQFHKGSNGRLSEITRLYVQNGKVIANSESKIAGVPGNSLTADFCTKQKKVFNDPDDFTKKGAWSGMSDALEAPMVLVMSLWHDHHSNMLWLDSTYPTDSTKLGSQRGSCSTSSGVPADLEKNVPNSKVAFSNIKFGPIGSTYKSDGTTPTNPTNPSEPSNTANPNPGTVDQWGQCGGSNYSGPTACKSGFTCKKINDFYSQCQ

SEQ ID NO: 39 - protein, 589 aa, Sclerotinia sclerotiorum
MYSAAVLATFSFLLGAGAQQVGTLKTESHPPLTIQKCAAGGTCTDEADSVVLDANWRWLHSTSGSTNCYTGNTWDTTLCPDAATCTANCAFDGADYEGTYGITSSGDSLKLSFVTGSNVGSRTYLMDSETTYKEFALLGNEFTFTVDVSKLPCGLNGALYFVPMDADGGMSKYPTNKAGAKYGTGYCDAQCPQDMKFVSGGANNEGWVPDSNSANSGTGNIGSCCSEFDVWEANSMSQALTPHTCTVDGQTACTGDDCAGNTGVCDADGCDFNPYRMGNTTFYGSGKTIDTTKPFSVVTQFITDDGTETGTLTEIKRFYVQDDVVYEQPNSDISGVSGNSITDDFCTAQKTAFGDTDYFSQKGGMAAMGKKMADGMVLVLSIWDDYNVNMLWLDSDYPTTKDASTPGVSRGSCATTSGVPATVEAASGSAYVTFSSIKYGPIGSTFKAPADSSSPVVASSSPAAVAAVVSTSSAQAVPSHPAVSSSQAAVSTPEAVSSAPEVPASSSAAQSVAPTSTKPKCSKVSQSSTLATSVAAPATTATSAAVAATSAASSSGSVPLYGNCTGGKTCSEGTCVVQNPWYSQCVASS

SEQ ID NO: 40 - protein, 510 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWDTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDGDGCDFNSFRMGDKTFLGKGMTVDTSKPFTVVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPYYSQCY

SEQ ID NO: 41 - protein, 513 aa, Trichoderma reesei
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNRGTTTTRRPATTTGSSPGPTQSHYGQCGGIGYSGPTVCASGTTCQVLNPYYSQCL

SEQ ID NO: 42 - protein, 541 aa, Aspergillus terreus
MPSTYDIYKKLLLLASFLSASQAQQVGTSKAEVHPSLTWQTCTSGGSCTTVNGKVVVDANWRWVHNVDGYNNCYTGNTWDTTLCPDDETCASNCALEGADYSGTYGVTTSGNSLRLNFVTQASQKNIGSRLYLMEDDSTYKMFKLLNQEFTFDVDVSNLPCGLNGAVYFVSMDADGGMAKYPANKAGAKYGTGYCDSQCPRDLKFINGMANVEGWEPSANDANAGTGNHGSCCAEMDIWEANSISTAYTPHPCDTPGQVMCTGDSCGGTYSSDRYGGTCDPDGCDFNSYRQGNKTFYGPGMTVDTKSKITVVTQFLTNDGTASGTLSEIKRFYVQNGKVIPNSESTWSGVSGNSITTAYCNAQKTLFGDTDVFTKHGGMEGMGAALAEGMVLVLSLWDDHNSNMLWLDSNYPTDKPSTTPGVARGSCDISSGDPKDVEANDANAYVVYSNIKVGPIGSTFSGSTGGGSSSSTTATSKTTTTSATKTTTTTTKTTTTTSASSTSTGGAQHWAQCGGIGWTGPTTCVAPYTCQKQNDYYSQCL

SEQ ID NO: 43 - protein, 516 aa, Botryotinia fuckeliana
MISKVLAFTSLLAAARAQQAGTLTTETHPPLSVSQCTASGCTTSAQSIVVDANWRWLHSTTGSTNCYTGNTWDKTLCPDGATCAANCALDGADYSGVYGITTSGNSIKLNFVTKGANTNVGSRTYLMAAGSTTQYQMLKLLNQEFTFDVDVSNLPCGLNGALYFAAMDADGGLSRFPTNKAGAKYGTGYCDAQCPQDIKFINGVANSVGWTPSSNDVNAGAGQYGSCCSEMDIWEANKISAAYTPHPCSVDTQTRCTGTDCGIGARYSSLCDADGCDFNSYRQGNTSFYGAGLTVNTNKVFTVVTQFITNDGTASGTLKEIRRFYVQNGVVIPNSQSTIAGVPGNSITDSFCAAQKTAFGDTNEFATKGGLATMSKALAKGMVLVMSIWDDHTANMLWLDAPYPATKSPSAPGVTRGSCSATSGNPVDVEANSPGSSVTFSNIKWGPINSTYTGSGAAPSVPGTTTVSSAPASTATSGAGGVAKYAQCGGSGYSGATACVSGSTCVALNPYYSQCQ

SEQ ID NO: 44 - protein, 458 aa, Volvariella volvacea
MFPAATLFAFSLFAAVYGQQVGTQLAETHPRLTWQKCTRSGGCQTQSNGAIVLDANWRWVHNVGGYTNCYTGNTWNTSLCPDGATCAKNCALDGANYQSTYGITTSGNALTLKFVTQSEQKNIGSRVYLLESDTKYQLFNPLNQEFTFDVDVSQLPCGLNGAVYFSAMDADGGMSKFPNNAAGAKYGTGYCDSQCPRDIKFINGEANVQGWQPSPNDTNAGTGNYGACCNEMDVWEANSISTAYTPHPCTQQGLVRCSGTACGGGSNRYGSICDPDGCDFNSFRMGDKSFYGPGLTVNTQQKFTVVTQFLTNNNSSSGTLREIRRLYVQNGRVIQNSKVNIPGMPSTMDSVTTEFCNAQKTAFNDTFSFQQKGGMANMSEALRRGMVLVLSIWDDHAANMLWLDSNYPTDRPASQPGVARGTCPTSSGKPSDVENSTANSQVIYSNIKFGDIGSTYSA

SEQ ID NO: 45 - protein, 537 aa, Penicillium janthinellum
  MOD_RES (48)..(48): Any amino acid
  MOD_RES (64)..(64): Any amino acid
MKGSISYQIYKGALLLSALLNSVSAQQVGTLTAETHPALTWSKCTAGXCSQVSGSVVIDANWPXVHSTSGSTNCYTGNTWDATLCPDDVTCAANCAVDGARRQHLRVTTSGNSLRINFVTTASQKNIGSRLYLLENDTTYQKFNLLNQEFTFDVDVSNLPCGLNGALYFVDMDADGGMAKYPTNKAGAKYGTGYCDSQCPRDLKFINGQANVDGWTPSKNDVNSGIGNHGSCCAEMDIWEANSISNAVTPHPCDTPSQTMCTGQRCGGTYSTDRYGGTCDPDGCDFNPYRMGVTNFYGPGETIDTKSPFTVVTQFLTNDGTSTGTLSEIKRFYVQGGKVIGNPQSTIVGVSGNSITDSWCNAQKSAFGDTNEFSKHGGMAGMGAGLADGMVLVMSLWDDHASDMLWLDSTYPTNATSTTPGAKRGTCDISRRPNTVESTYPNAYVIYSNIKTGPLNSTFTGGTTSSSSTTTTTSKSTSTSSSSKTTTTVTTTTTSSGSSGTGARDWAQCGGNGWTGPTTCVSPYTCTKQNDWYSQCL

SEQ ID NO: 46 - protein, 523 aa, Pleurotus sp.
MFRTAALTAFTLAAVVLGQQVGTLTAENHPALSIQQCTASGCTTQQKSVVLDSNWRWTHSLPVHTNCYTGNAWDASLCPDPTTCATNCAIDGADYSGTYGITTSGNALTLRFVTNGPYSKNIGSRVYLLDDADHYKMFDLKNQEFTFDVDMSGLPCGLNGALYFSEMPADGGKAAHTSNKAGAKYGTGYCDAQCPHDIKWINGEANILDWSASATDANAGNGRYGACCAEMDIWEANSEATAYTPHVCRDEGLYRCSGTECGDGDNRYGGVCDKDGCDFNSYRMGDKNFLGRGKTIDTTKKITVVTQFITDDNTSSGNLVEIRRVYVQDGVTYQNSFSTFPSLSQYNSISDDFCVAQKTLFGDNQYYNTHGGTEKMGDAMANGMVLIMSLWSDHAAHMLWLDSDYPLDKSPSEPGVSRGACATTTGDPDDVVANHPNASVTFSNIKYGPIGSTYGGSTPPVSSGNTSAPPVTSTTSSGPTTPTGPTGTVPKWGQCGGNGYSGPTTCVAGSTCTYSNDWYSQCL

SEQ ID NO: 47 - protein, 446 aa, Aspergillus nidulans
MYQRALLFSALLSVSRAQQAGTAQEEVHPSLTWQRCEASGSCTEVAGSVVLDSNWRWTHSVDGYTNCYTGNEWDATLCPDNESCAQNCAVDGADYEATYGITSNGDSLTLKFVTGSNVGSRVYLMEDDETYQMFDLLNNEFTFDVDVSNLPCGLNGALYFTSMDADGGLSKYEGNTAGAKYGTGYCDSQCPRDIKFINGLGNVEGWEPSDSDANAGVGGMGTCCPEMDIWEANSISTAYTPHPCDSVEQTMCEGDSCGGTYSDDRYGGTCDPDGCDFNSYRMGNTSFYGPGAIIDTSSKFTVVTQFIADGGSLSEIKRFYVQNGEVIPNSESNISGVEGNSITSEFCTAQKTAFGDEDIFAQHGGLSAMGDAASAMVLILSIWDDHHSSMMWLDSSYPTDADPSQPGVARGTCEQGAGDPDVVESEHADASVTFSNIKFGPIGSTF

SEQ ID NO: 48 - protein, 511 aa, Fusarium poae
MYRAIATASALIAAVRAQQVCSLTTETKPALTWSKCTSSGCSNVQGSVTIDANWRWTHQVSGSTNCHTGNKWDTSVCTSGKVCAEKCCVDGADYASTYGITSSGNQLSLSFVTKGSYGTNIGSRTYLMEDENTYQMFQLLGNEFTFDVDVSNIGCGLNGALYFVSMDADGGKAKYPGNKAGAKYGTGYCDAQCPRDVKFINGQANSDGWEPSKSDVNGGIGNLGTCCPEMDIWEANSISTAYTPHPCTKLTQHACTGDSCGGTYSNDRYGGTCDADGCDFNAYRQGNKTFYGPGSGFNVDTTKKVTVVTQFHKGSNGRLSEITRLYVQNGKVIANSESKIAGNPGSSLTSDFCTTQKKVFGDIDDFAKKGAWNGMSDALEAPMVLVMSLWHDHHSNMLWLDSTYPTDSTALGSQRGSCSTSSGVPADLEKNVPNSKVAFSNIKFGPIGSTYNKEGTQPQPTNPTNPNPTNPTNPGTVDQWGQCGGTNYSGPTACKSPFTCKKINDFYSQCQ

SEQ ID NO: 49 - protein, 523 aa, Pleurotus sp.
MFRTAALTAFTLAAVVLGQQVGTLAAENHPALSIQQCTASGCTTQQKSVVLDSNWRWTHSTAGATNCYTGNAWDSSLCPNPTTCATNCAIDGADYSGTYGITTSGNSLTLRFVTNGQYSENIGSRVYLLDDADHYKLFNLKNQEFTFDVDMSGLPCGLNGALYFSEMAADGGKAAHTGNNAGAKYGTGYCDAQCPHDIKWINGEANILDWSGSATDPNAGNGRYGACCAEMDIWEANSEATAYTPHVCRDEGLYRCSGTECGDGDNRYGGVCDKDGCDFNSYRMGDKNFLGRGKTIDTTKKITVVTQFITDDNTPTGNLVEIRRVYVQDGVTYQNSFSTFPSLSQYNSISDDFCVAQKTLFGDNQYYNTHGGTEKMGDSLANGMVLIMSLWSDHAAHMLWLDSDYPLDKSPSEPGVSRGACATTTGDPDDVVANHPNASVTFSNIKYGPIGSTYGGSTPPVSSGNTSVPPVTSTTSSGPTTPTGPTGTVPKWGQCGGIGYSGPTSCVAGSTCTYSNEWYSQCL

SEQ ID NO: 50 - protein, 513 aa, Trichoderma viride
MYQKLALISAFLATARAQSACTLQAETHPPLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVTKYPTNTAGAKYGTGYCDSQCPRDLKFINGQANVEGWEPSSNNANTGIGGHGSCCSEMDIWEANSISEALTPHPCTTVGQEICEGDSCGGTYSGDRYGGTCDPDGCDWNPYRLGNTSFYGPGSSFTLDTTKKLTVVTQFETSGAINRYYVQNGVTFQQPNAELGDYSGNSLDDDYCAAEEAEFGGSSFSDKGGLTQFKKATSGGMVLVMSLWDDYYANMLWLDSTYPTDETSSTPGAVRGSSSTSSGVPAQLESNSPNAKVVYSNIKFGPIGSTGNPSGGNPPGGNPPGTTTPRPATSTGSSPGPTQTHYGQCGGIGYIGPTVCASGSTCQVLNPYYSQCL

SEQ ID NO: 51 - protein, 423 aa, Alternaria alternata
MTWQSCTAKGSCTNKNGKIVIDANWRWLHKKEGYDNCYTGNEWDATACPDNKACAANCAVDGADYSGTYGITAGSNSLKLKFITKGSYSTNIGSRTYLMKDDTTYEMFKFTGNQEFTFDVDVSNLPCGFNGALYFVSMDADGGLKKYSTNKAGAKYGTGYCDAQCPRDLKFINGEGNVEGWKPSSNDANAGVGGHGSCCAEMDIWEANSVSTAVTPHSCSTIEQSRCDGDGCGGTYSADRYAGVCDPDGCDFNSYRMGVKDFYGKGKTVDTSKKFTVVTQFIGTGDAMEIKRFYVQNGKTIAQPASAVPGVEGNSITTKFCDQQKAVFGDTYTFKDKGGMANMAKALANGMVLVMSLWDDHYSNMLWLDSTYPTDKNPDTDLGTGRGECETSSGVPADVESQHADATVVYSNIKFGPLNSTFG

SEQ ID NO: 52 - protein, 535 aa, Neosartorya fischeri
MASAISFQVYRSALILSAFLPSITQAQQIGTYTTETHPSMTWETCTSGGSCATNQGSVVMDANWRWVHQVGSTTNCYTGNTWDTSICDTDETCATECAVDGADYESTYGVTTSGSQIRLNFVTQNSNGANVGSRLYMMADNTHYQMFKLLNQEFTFDVDVSNLPCGLNGALYFVTMDEDGGVSKYPNNKAGAQYGVGYCDSQCPRDLKFIQGQANVEGWTPSSNNENTGLGNYGSCCAELDIWESNSISQALTPHPCDTATNTMCTGDACGGTYSSDRYAGTCDPDGCDFNPYRMGNTTFYGPGKTIDTNSPFTVVTQFITDDGTDTGTLSEIRRYYVQNGVTYAQPDSDISGITGNAINADYCTAENTVFDGPGTFAKHGGFSAMSEAMSTGMVLVMSLWDDYYADMLWLDSTYPTNASSSTPGAVRGSCSTDSGVPATIESESPDSYVTYSNIKVGPIGSTFSSGSGSGSSGSGSSGSASTSTTSTKTTAATSTSTAVAQHYSQCGGQDWTGPTTCVSPYTCQVQNAYYSQCL

SEQ ID NO: 53 - protein, 450 aa, Neurospora crassa
MKAYFEYLVAALPLLGLATAQQVGKQTTETHPKLSWKKCTGKANCNTVNAEVVIDSNWRWLHDSSGKNCYDGNKWTSACSSATDCASKCQLDGANYGTTYGASTSGDALTLKFVTKHEYGTNIGSRFYLMNGASKYQMFTLMNNEFAFDVDLSTVECGLNAALYFVAMEEDGGMASYSSNKAGAKYGTGYCDAQCARDLKFVGGKANIEGWTPSTNDANAGVGPYGGCCAEIDVWESNAHSFAFTPHACKTNKYHVCERDNCGGTYSEDRFAGLCDANGCDYNPYRMGNTDFYGKGKTVDTSKKFTVVSRFEENKLTQFFVQNGQKIEIPGPKWDGIPSDNANITPEFCSAQFQAFGDRDRFAEVGGFAQLNSALRMPMVLVMSIWDDHYANMLWLDSVYPPEKEGQPGAARGDCPQSSGVPAEVESQYANSKVVYSNIRFGPVGSTVNV

SEQ ID NO: 54 - protein, 452 aa, Cryphonectria parasitica
MFSKFALTGSLLAGAVNAQGVGTQQTETHPQMTWQSCTSPSSCTTNQGEVVIDSNWRWVHDKDGYVNCYTGNTWNTTLCPDDKTCAANCVLDGADYSSTYGITTSGNALSLQFVTQSSGKNIGSRTYLMESSTKYHLFDLIGNEFAFDVDLSKLPCGLNGALYFVTMDADGGMAKYSTNTAGAEYGTGYCDSQCPRDLKFINGQGNVEGWTPSTNDANAGVGGLGSCCSEMDVWEANSMDMAYTPHPCETAAQHSCNADECGGTYSSSRYAGDCDPDGCDWNPFRMGNKDFYGSGDTVDTSQKFTVVTQFHGSGSSLTEISQYYIQGGTKIQQPNSTWPTLTGYNSITDDFCKAQKVEFNDTDVFSEKGGLAQMGAGMADGMVLVMSLWDDHYANMLWLDSTYPVDADASSPGKQRGTCATTSGVPADVESSDASATVIYSNIKFGPIGATY

SEQ ID NO: 55 - protein, 530 aa, Corticium rolfsii
MFPAAALLSFTLLAVASAQQIGTNTAEVHPSLTVSQCTTSGGCTSSTQSIVLDANWRWLHSTSGYTNCYTGNQWNSDLCPDPDTCATNCALDGASYESTYGISTDGNAVTLNFVTQGSQTNVGSRVYLLSDDTHYQTFSLLNKEFSFDVDASNIGCGINGAVYFVQMDADGGLSKYSSNKAGAQYGTGYCDSQCPQDIKFINGEANLLDWNATSANSGTGSYGSCCPEMDIWEANKYAAAYTPHPCSVSGQTRCTGTSCGAGSERYDGYCDKDGCDFNSWRMGNETFLGPGMTIDTNKKFTIVTQFITDDNTANGTLSEIRRLYVQGGTVIQNSVANQPNIPKVNSITDSFCTAQKTEFGDQDYFGTIGGLSQMGKAMSDMVLVMSIWDDYDAEMLWLDSNYPTSGSASTPGISRGPCSATSGLPATVESQQASASVTYSNIKWGDIGSTYSGSGSSGSSSSSSSSAASASTSTHTSAAATATSSAAAATGSPVPAYGQCGGQSYTGSTTCASPYVCKVSNAYYSQCLPA

SEQ ID NO: 56 - protein, 449 aa, Magnaporthe grisea
MKRALCASLSLLAAAVAQQVGTNEPEVHPKMTWKKCSSGGSCSTVNGEVVIDGNWRWIHNIGGYENCYSGNKWTSVCSTNADCATKCAMEGAKYQETYGVSTSGDALTLKFVQQNSSGKNVGSRMYLMNGANKYQMFTLKNNEFAFDVDLSSVECGMNSALYFVPMKEDGGMSTEPNNKAGAKYGTGYCDAQCARDLKFIGGKGNIEGWQPSSTDSSAGIGAQGACCAEIDIWESNKNAFAFTPHPCENNEYHVCTEPNCGGTYADDRYGGGCDANGCDYNPYRMGNPDFYGPGKTIDTNRKFTVISRFENNRNYQILMQDGVAHRIPGPKFDGLEGETGELNEQFCTDQFTVFDERNRFNEVGGWSKLNAAYEIPMVLVMSIWSDHFANMLWLDSTYPPEKAGQPGSARGPCPADGGDPNGVVNQYPNAKVIWSNVRFGPIGSTYQVD

SEQ ID NO: 57 - protein, 448 aa, Magnaporthe grisea
MQLTKAGVFLGALMGGAAAQQVGTQTAENHPKMTWKKCTGKASCTTVNGEVVIDANWRWLHDASSKNCYDGNRWTDSCRTASDCAAKCSLEGADYAKTYGASTSGDALSLKFVTRHDYGTNIGSRFYLMNGASKYQMFSLLGNEFAFDVDLSTIECGLNSALYFVAMEEDGGMKSYSSNKAGAKYGTGYCDAQCARDLKFVGGKANIEGWKPSSNDANAGVGPYGACCAEIDVWESNAHAFAFTPHPCTDNKYHVCQDSNCGGTYSDDRFAGKCDANGCDINPYRLGNTDFYGKGKTVDTSKKFTVVTRFERDALTQFFVQNNKRIDMPSPALEGLPATGAITAEYCTNVFNVFGDRNRFDEVGGWSQLQQALSLPMVLVMSIWDDHYSNMLWLDSVYPPDKEGSPGAARGDCPQDSGVPSEVESQIPGATVVWSNIRFGPVGSTVNV

SEQ ID NO: 58 - protein, 514 aa, Fusarium oxysporum
MYRIVATASALIAAARAQQVCSLNTETKPALTWSKCTSSGCSDVKGSVVIDANWRWTHQTSGSTNCYTGNKWDTSICTDGKTCAEKCCLDGADYSGTYGITSSGNQLSLGFVTNGPYSKNIGSRTYLMENENTYQMFQLLGNEFTFDVDVSGIGCGLNGAPHFVSMDEDGGKAKYSGNKAGAKYGTGYCDAQCPRDVKFINGVANSEGWKPSDSDVNAGVGNLGTCCPEMDIWEANSISTAFTPHPCTKLTQHSCTGDSCGGTYSSDRYGGTCDADGCDFNAYRQGNKTFYGPGSNFNIDTTKKMTVVTQFHKGSNGRLSEITRLYVQNGKVIANSESKIAGNPGSSLTSDFCSKQKSVFGDIDDFSKKGGWNGMSDALSAPMVLVMSLWHDHHSNMLWLDSTYPTDSTKVGSQRGSCATTSGKPSDLERDVPNSKVSFSNIKFGPIGSTYKSDGTTPNPPASSSTTGSSTPTNPPAGSVDQWGQCGGQNYSGPTTCKSPFTCKKINDFYSQCQ

SEQ ID NO: 59 - protein, 453 aa, Aspergillus clavatus
MYQRALLFSALATAVSAQQVGTQKAEVHPALTWQKCTAAGSCTDQKGSVVIDANWRWLHSTEDTTNCYTGNEWNAELCPDNEACAKNCALDGADYSGTYGVTADGSSLKLNFVTSANVGSRLYLMEDDETYQMFNLLNNEFTFDVDVSNLPCGLNGALYFVSMDADGGLSKYPGNKAGAKYGTGYCDSQCPRDLKFINGEANVEGWKPSDNDKNAGVGGYGSCCPEMDIWEANSISTAYTPHPCDGMEQTRCDGNDCGGTYSSTRYAGTCDPDGCDFNSFRMGNESFYGPGGLVDTKSPITVVTQFVTAGGTDSGALKEIRRVYVQGGKVIGNSASNVAGVEGDSITSDFCTAQKKAFGDEDIFSKHGGLEGMGKALNKMALIVSIWDDHASSMMWLDSTYPVDADASTPGVARGTCEHGLGDPETVESQHPDASVTFSNIKFGPIGSTYKSV

SEQ ID NO: 60 - protein, 529 aa, Penicillium funiculosum
MSALNSFNMYKSALILGSLLATAGAQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSNLPCGLNGALYFVTMDADGGVSKYPNNKAGAQYGVGYCDSQCPRDLKFIAGQANVEGWTPSTNNSNTGIGNHGSCCAELDIWEANSISEALTPHPCDTPGLTVCTADDCGGTYSSNRYAGTCDPDGCDFNPYRLGVTDFYGSGKTVDTTKPFTVVTQFVTDDGTSSGSLSEIRRYYVQNGVVIPQPSSKISGISGNVINSDFCAAELSAFGETASFTNHGGLKNMGSALEAGMVLVMSLWDDYSVNMLWLDSTYPANETGTPGAARGSCPTTSGNPKTVESQSGSSYVVFSDIKVGPFNSTFSGGTSTGGSTTTTASGTTSTKASTTSTSSTSTGTGVAAHWGQCGGQGWTGPTTCASGTTCTVVNPYYSQCL

SEQ ID NO: 61 - protein, 525 aa, Humicola grisea
MRTAKFATLAALVASAAAQQACSLTTERHPSLSWNKCTAGGQCQTVQASITLDSNWRWTHQVSGSTNCYTGNKWDTSICTDAKSCAQNCCVDGADYTSTYGITTNGDSLSLKFVTKGQHSTNVGSRTYLMDGEDKYQTFELLGNEFTFDVDVSNIGCGLNGALYFVSMDADGGLSRYPGNKAGAKYGTGYCDAQCPRDIKFINGEANIEGWTGSTNDPNAGAGRYGTCCSEMDIWEANNMATAFTPHPCTIIGQSRCEGDSCGGTYSNERYAGVCDPDGCDFNSYRQGNKTFYGKGMTVDTTKKITVVTQFLKDANGDLGEIKRFYVQDGKIIPNSESTIPGVEGNSITQDWCDRQKVAFGDIDDFNRKGGMKQMGKALAGPMVLVMSIWDDHASNMLWLDSTFPVDAAGKPGAERGACPTTSGVPAEVEAEAPNSNVVFSNIRFGPIGSTVAGLPGAGNGGNNGGNPPPPTTTTSSAPATTTTASAGPKAGRWQQCGGIGFTGPTQCEEPYICTKLNDWYSQCL

SEQ ID NO: 62 - protein, 532 aa, Chaetomium thermophilum
MMYKKFAALAALVAGASAQQACSLTAENHPSLTWKRCTSGGSCSTVNGAVTIDANWRWTHTVSGSTNCYTGNQWDTSLCTDGKSCAQTCCVDGADYSSTYGITTSGDSLNLKFVTKHQYGTNVGSRVYLMENDTKYQMFELLGNEFTFDVDVSNLGCGLNGALYFVSMDADGGMSKYSGNKAGAKYGTGYCDAQCPRDLKFINGEANVGNWTPSTNDANAGFGRYGSCCSEMDVWEANNMATAFTPHPCTTVGQSRCEADTCGGTYSSDRYAGVCDPDGCDFNAYRQGDKTFYGKGMTVDTNKKMTVVTQFHKNSAGVLSEIKRFYVQDGKIIANAESKIPGNPGNSITQEYCDAQKVAFSNTDDFNRKGGMAQMSKALAGPMVLVMSVWDDHYANMLWLDSTYPIDQAGAPGAERGACPTTSGVPAEIEAQVPNSNVIFSNIRFGPIGSTVPGLDGSNPGNPTTTVVPPASTSTSRPTSSTSSPVSTPTGQPGGCTTQKWGQCGGIGYTGCTNCVAGTTCTQLNPWYSQCL

SEQ ID NO: 63 - protein, 465 aa, Aspergillus oryzae
MASLSLSKICRNALILSSVLSTAQGQQVGTYQTETHPSMTWQTCGNGGSCSTNQGSVVLDANWRWVHQTGSSSNCYTGNKWDTSYCSTNDACAQKCALDGADYSNTYGITTSGSEVRLNFVTSNSNGKNVGSRVYMMADDTHYEVYKLLNQEFTFDVDVSKLPCGLNGALYFVVMDADGGVSKYPNNKAGAKYGTGYCDSQCPRDLKFIQGQANVEGWVSSTNNANTGTGNHGSCCAELDIWESNSISQALTPHPCDTPTNTLCTGDACGGTYSSDRYSGTCDPDGCDFNPYRVGNTTFYGPGKTIDTNKPITVVTQFITDDGTSSGTLSEIKRFYVQDGVTYPQPSADVSGLSGNTINSEYCTAENTLFEGSGSFAKHGGLAGMGEAMSTGMVLVMSLWDDYYANMLWLDSNYPTNESTSKPGVARGTCSTSSGVPSEVEASNPSAYVAYSNIKVGPIGSTFKS

SEQ ID NO: 64 - protein, 510 aa, Gibberella pulicaris
MYRAIATASALIAAVRAQQVCSLTPETKPALSWSKCTSSGCSNVQGSVTIDANWRWTHQLSGSTNCYTGNKWDTSICTSGKVCAEKCCIDGAEYASTYGITSSGNQLSLSFVTKGAYGTNIGSRTYLMEDENTYQMFQLLGNEFTFDVDVSNIGCGLNGALYFVSMDADGGKAKYPGNKAGAKYGTGYCDAQCPRDVKFINGQANSDGWQPSKSDVNAGIGNMGTCCPEMDIWEANSISTAYTPHPCTKLTQHSCTGDSCGGTYSNDRYGGTCDADGCDFNAYRQGNKTFYGPGSGFNVDTTKKVTVVTQFHKGSNGRLSEITRLYVQNGKVIANSESKIAGVPGSSLTPEFCTAQKKVFGDTDDFAKKGAWSGMSDALEAPMVLVMSLWHDHHSNMLWLDSTYPTDSTKLGAQRGSCSTSSGVPADLEKNVPNSKVAFSNIKFGPIGSTYKEGVPEPTNPTNPTNPTNPTNPGTVDQWAQCGGTNYSGPTACKSPFTCKKINDFYSQCQ

SEQ ID NO: 65 - protein, 512 aa, Volvariella volvacea
MFPKSSLLVLSFLATAYAQQVGTQTAEVHPSLNWARCTSSGCTNVAGSVTLDANWRWLHTTSGYTNCYTGNSWNTTLCPDGATCAQNCALDGANYQSTCGITTSGNALTLKFVTQGEQKNIGSRVYLMASESRYEMFGLLNKEFTFDVDVSNLPCGLNGALYFSSMDADGGMAKNPGNKAGAKYGTGYCDSQCPRDIKFINGEANVAGWNGSPNDTNAGTGNWGACCNEMDIWEANSISAAYTPHPCTVQGLSRCSGTACGTNDRYGTVCDPDGCDFNSYRMGDKTYYGPGGTGVDTRSKFTVVTQFLTNNNSSSGTLSEIRRLYVQNGRVVQNSKVNIPGMSNTLDSITTGFCDSQKTAFGDTRSFQNKGGMSAMGQALGAGMVLVLSVWDDHAANMLWLDSNYPVDADPSKPGIARGTCSTTSGKPTDVEQSAANSSVTFSNIKFGDIGTTYTGGSVTTTPGNPGTTTSTAPGAVQTKWGQCGGQGWTGPTRCESGSTCTVVNQWYSQCI

SEQ ID NO: 66 - protein, 521 aa, Irpex lacteus
MFRKAALLAFSFLAIAHGQQVGTNQAENHPSLPSQHCTASGCTTSSTSVVLDANWRWVHTTTGYTNCYTGQTWDASICPDGVTCAKACALDGADYSGTYGITTSGNALTLQFVKGTNVGSRVYLLQDASNYQLFKLINQEFTFDVDMSNLPCGLNGAVYLSQMDQDGGVSRFPTNTAGAKYGTGYCDSQCPRDIKFINGEANVAGWTGSSSDPNSGTGNYGTCCSEMDIWEANSVAAAYTPHPCSVNQQTRCTGADCGQDANRYKGVCDPDGCDFNSFRMGDQTFLGKGLTVDTSRKFTIVTQFISDDGTSSGNLAEIRRFYVQDGKVIPNSKVNIAGCDAVNSITDKFCTQQKTAFGDTNRFADQGGLKQMGAALKSGMVLALSLWDDHAANMLWLDSDYPTTADASKPGVARGTCPNTSGVPKDVESQSGSATVTYSNIKWGDLNSTFSGTASNPTGPSSSPSGPSSSSSSTAGSQPTQPSSGSVAQWGQCGGIGYSGATGCVSPYTCHVVNPYYSQCY

SEQ ID NO: 67 - protein, 505 aa, Chaetomium thermophilum
TETHPRLTWKRCTSGGNCSTVNGAVTIDANWRWTHTVSGSTNCYTGNEWDTSICSDGKSCAQTCCVDGADYSSTYGITTSGDSLNLKFVTKHQHGTNVGSRVYLMENDTKYQMFELLGNEFTFDVDVSNLGCGLNGALYFVSMDADGGMSKYSGNKAGAKYGTGYCDAQCPRDLKFINGEANIENWTPSTNDANAGFGRYGSCCSEMDIWEANNMATAFTPHPCTIIGQSRCEGNSCGGTYSSERYAGVCDPDGCDFNAYRQGDKTFYGKGMTVDTTKKMTVVTQFHKNSAGVLSEIKRFYVQDGKIIANAESKIPGNPGNSITQEWCDAQKVAFGDIDDFNRKGGMAQMSKALEGPMVLVMSVWDDHYANMLWLDSTYPIDKAGTPGAERGACPTTSGVPAEIEAQVPNSNVIFSNIRFGPIGSTVPGLDGSTPSNPTATVAPPTSTTTSVRSSTTQISTPTSQPGGCTTQKWGQCGGIGYTGCTNCVAGTTCTELNPWYSQCL

SEQ ID NO: 68 - protein, 526 aa, Irpex lacteus
MFHKAVLVAFSLVTIVHGQQAGTQTAENHPQLSSQKCTAGGSCTSASTSVVLDSNWRWVHTTSGYTNCYTGNTWDASICSDPVSCAQNCALDGADYAGTYGITTSGDALTLKFVTGSNVGSRVYLMEDETNYQMFKLMNQEFTFDVDVSNLPCGLNGAVYFVQMDQDGGTSKFPNNKAGAKFGTGYCDSQCPQDIKFINGEANIVDWTASAGDANSGTGSFGTCCQEMDIWEANSISAAYTPHPCTVTEQTRCSGSDCGQGSDRFNGICDPDGCDFNSFRMGNTEFYGKGLTVDTSQKFTIVTQFISDDGTADGNLAEIRRFYVQNGKVIPNSVVQITGIDPVNSITEDFCTQQKTVFGDTNNFAAKGGLKQMGEAVKNGMVLALSLWDDYAAQMLWLDSDYPTTADPSQPGVARGTCPTTSGVPSQVEGQEGSSSVIYSNIKFGDLNSTFTGTLTNPSSPAGPPVTSSPSEPSQSTQPSQPAQPTQPAGTAAQWAQCGGMGFTGPTVCASPFTCHVLNPYYSQCY

SEQ ID NO: 69 - protein, 511 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWNTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDHGDGCDFNSFRMGDKTFLGKGMTVDTSKPFTDVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPYYSQCY

SEQ ID NO: 70 - protein, 452 aa, Melanocarpus albomyces
MMMKQYLQYLAAALPLVGLAAGQRAGNETPENHPPLTWQRCTAPGNCQTVNAEVVIDANWRWLHDDNMQNCYDGNQWTNACSTATDCAEKCMIEGAGDYLGTYGASTSGDALTLKFVTKHEYGTNVGSRFYLMNGPDKYQMFNLMGNELAFDVDLSTVECGINSALYFVAMEEDGGMASYPSNQAGARYGTGYCDAQCARDLKFVGGKANIEGWKSSTSDPNAGVGPYGSCCAEIDVWESNAYAFAFTPHACTTNEYHVCETTNCGGTYSEDRFAGKCDANGCDYNPYRMGNPDFYGKGKTLDTSRKFTVVSRFEENKLSQYFIQDGRKIEIPPPTWEGMPNSSEITPELCSTMFDVFNDRNRFEEVGGFEQLNNALRVPMVLVMSIWDDHYANMLWLDSIYPPEKEGQPGAARGDCPTDSGVPAEVEAQFPDAQVVWSNIRFGPIGSTYDF

SEQ ID NO: 71 - protein, 454 aa, Podospora anserina
MYRSATFLTFASLVLGQQVGTYTAERHPSMPIQVCTAPGQCTRESTEVVLDANWRWTHITNGYTNCYTGNEWNATACPDGATCAKNCAVDGADYSGTYGITTPSSGALRLQFVKKNDNGQNVGSRVYLMASSDKYKLFNLLNKEFTFDVDVSKLPCGLNGAVYFSEMLEDGGLKSFSGNKAGAKYGTGYCDSQCPQDIKFINGEANVEGWGGADGNSGTGKYGICCAEMDIWEANSDATAYTPHVCSVNEQTRCEGVDCGAGSDRYNSICDKDGCDFNSYRLGNREFYGPGKTVDTTRPFTIVTQFVTDDGTDSGNLKSIHRYYVQDGNVIPNSVTEVAGVDQTNFISEGFCEQQKSAFGDNNYFGQLGGMRAMGESLKKMVLVLSIWDDHAVNMNWLDSIFPNDADPEQPGVARGRCDPADGVPATIEAAHPDAYVIYSNIKFGAINSTFTAN

SEQ ID NO: 72 - protein, 456 aa, Cochliobolus carbonum
MYRTLAFASLSLYGAARAQQVGTSTAENHPKLTWQTCTGTGGTNCSNKSGSVVLDSNWRWAHNVGGYTNCYTGNSWSTQYCPDGDSCTKNCAIDGADYSGTYGITTSNNALSLKFVTKGSFSSNIGSRTYLMETDTKYQMFNLINKEFTFDVDVSKLPCGLNGALYFVEMAADGGIGKGNNKAGAKYGTGYCDSQCPHDIKFINGKANVEGWNPSDADPNGGAGKIGACCPEMDIWEANSISTAYTPHPCRGVGLQECSDAASCGDGSNRYDGQCDKDGCDFNSYRMGVKDFYGPGATLDTTKKMTVITQFLGSGSSLSEIKRFYVQNGKVYKNSQSAVAGVTGNSITESFCTAQKKAFGDTSSFAALGGLNEMGASLARGHVLIMSLWGDHAVNMLWLDSTYPTDADPSKPGAARGTCPTTSGKPEDVEKNSPDATVVFSNIKFGPIGSTFAQPA

SEQ ID NO: 73 - protein, 514 aa, Trichoderma viride
MYQKLALISAFLATARAQSACTLQAETHPPLTWQKCSSGGTCTQQTGSVVIDANWRWTHATNSSTNCYDGNTWSSTLCPDNETCAKNCCLDGAAYASTYGVTTSADSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICDGDSCGGTYSGDRYGGTCDPDGCDWNPYRLGNTSFYGPGSSFTLDTTKKLTVVTQFETSGAINRYYVQNGVTFQQPNAELGDYSGNSLDDDYCAAEEAEFGGSSFSDKGGLTQFKKATSGGMVLVMSLWDDYYANMLWLDSTYPTNETSSTPGAVRGSCSTSSGVPAQLESNSPNAKVVYSNIKFGPIGSTGNSSGGNPPGGNPPGTTTTRRPATSTGSSPGPTQTHYGQCGGIGYSGPTVCASGSTCQVLNPYYSQCL

SEQ ID NO: 74 - protein, 540 aa, Aspergillus aculeatus
MVDSFSIYKTALLLSMLATSNAQQVGTYTAETHPSLTWQTCSGSGSCTTTSGSVVIDANWRWVHEVGGYTNCYSGNTWDSSICSTDTTCASECALEGATYESTYGVTTSGSSLRLNFVTTASQKNIGSRLYLLADDSTYETFKLFNREFTFDVDVSNLPCGLNGALYFVSMDADGGVSRFPTNKAGAKYGTGYCDSQCPRDLKFIDGQANIEGWEPSSTDVNAGTGNHGSCCPEMDIWEANSISSAFTAHPCDSVQQTMCTGDTCGGTYSDTTDRYSGTCDPDGCDFNPYRFGNTNFYGPGKTVDNSKPFTVVTQFITHDGTDTGTLTEIRRLYVQNGVVIGNGPSTYTAASGNSITESFCKAEKTLFGDTNVFETHGGLSAMGDALGDGMVLVLSLWDDHAADMLWLDSDYPTTSCASSPGVARGTCPTTTGNATYVEANYPNSYVTYSNIKFGTLNSTYSGTSSGGSSSSSTTLTTKASTSTTSSKTTTTTSKTSTTSSSSTNVAQLYGQCGGQGWTGPTTCASGTCTKQNDYYSQCL

SEQ ID NO: 75 - protein, 457 aa, Dictyostelium discoideum
MYRILKSFILLSLVNMSLSQKIGKLTPEVHPPMTFQKCSEGGSCETIQGEVVVDANWRWVHSAQGQNCYTGNTWNPTICPDDETCAENCYLDGANYESVYGVTTSEDSVRLNFVTQSQGKNIGSRLFLMSNESNYQLFHVLGQEFTFDVDVSNLDCGLNGALYLVSMDSDGGSARFPTNEAGAKYGTGYCDAQCPRDLKFISGSANVDGWIPSTNNPNTGYGNLGSCCAEMDLWEANNMATAVTPHPCDTSSQSVCKSDSCGGAASSNRYGGICDPDGCDYNPYRMGNTSFFGPNKMIDTNSVITVVTQFITDDGSSDGKLTSIKRLYVQDGNVISQSVSTIDGVEGNEVNEEFCTNQKKVFGDEDSFTKHGGLAKMGEALKDGMVLVLSLWDDYQANMLWLDSSYPTTSSPTDPGVARGSCPTTSGVPSKVEQNYPNAYVVYSNIKVGPIDSTYKK

SEQ ID NO: 76 - protein, 504 aa, Sclerotinia sclerotiorum
MISRVLAISSLLAAARAQQIGTNTAEVHPALTSIVIDANWRWLHTTSGYTNCYTGNSWDATLCPDAVTCAANCALDGADYSGTYGITTSGNSLKLNFVTKGANTNVGSRTYLMAAGSKTQYQLLKLLGQEFTFDVDVSNLPCGLNGALYFAEMDADGGVSRFPTNKAGAQYGTGYCDAQCPQDIKFINGQANSVGWTPSSNDVNTGTGQYGSCCSEMDIWEANKISAAYTPHPCSVDGQTRCTGTDCGIGARYSSLCDADGCDFNSYRMGDTGFYGAGLTVDTSKVFTVVTQFITNDGTTSGTLSEIRRFYVQNGKVIPNSQSKVTGVSGNSITDSFCAAQKTAFGDTNEFATKGGLATMSKALAKGMVLVMSIWDDHSANMLWLDAPYPASKSPSAAGVSRGSCSASSGVPADVEANSPGASVTYSNIKWGPINSTYSAGTGSNTGSGSGSTTTLVSSVPSSTPTSTTGVPKYGQCGGSGYTGPTNCIGSTCVSMGQYYSQCQ

SEQ ID NO: 77 - protein, 452 aa, Chaetomium globosum
MYRQVATALSFASLVLGQQVGTLTAETHPSLPIEVCTAPGSCTKEDTTVVLDANWRWTHVTDGYTNCYTGNAWNETACPDGKTCAANCAIDGAEYEKTYGITTPEEGALRLNFVTESNVGSRVYLMAGEDKYRLFNLLNKEFTMDVDVSNLPCGLNGAVYFSEMDEDGGMSRFEGNKAGAKYGTGYCDSQCPRDIKFINGEANSEGWGGEDGNSGTGKYGTCCAEMDIWEANLDATAYTPHPCKVTEQTRCEDDTECGAGDARYEGLCDRDGCDFNSFRLGNKEFYGPEKTVDTSKPFTLVTQFVTADGTDTGALQSIRRFYVQDGTVIPNSETVVEGVDPTNEITDDFCAQQKTAFGDNNHFKTIGGLPAMGKSLEKMVLVLSIWDDHAVYMNWLDSNYPTDADPTKPGVARGRCDPEAGVPETVEAAHPDAYVIYSNIKIGALNSTFAAA

SEQ ID NO: 78 - protein, 536 aa, Aspergillus niger
MSSFQVYRAALLLSILATANAQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGQEFTFDVDVSNLPCGLNGALYFVAMDADGGTSEYSGNKAGAKYGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGSGSSSSSSSTTTKATSTTLKTTSTTSSGSSSTSAAQAYGQCGGQGWTGPTTCVSGYTCTYENAYYSQCL

SEQ ID NO: 79 - protein, 508 aa, Nectria haematococca
MYRAIATASALLATARAQQVCTLNTENKPALTWAKCTSSGCSNVRGSVVVDANWRWAHSTSSSTNCYTGNTWDKTLCPDGKTCADKCCLDGADYSGTYGVTSSGNQLNLKFVTVGPYSTNVGSRLYLMEDENNYQMFDLLGNEFTFDVDVNNIGCGLNGALYFVSMDKDGGKSRFSTNKAGAKYGTGYCDAQCPRDVKFINGVANSDEWKPSDSDKNAGVGKYGTCCPEMDIWEANKISTAYTPHPCKSLTQQSCEGDACGGTYSATRYAGTCDPDGCDFNPYRQGNKTFYGPGSGFNVDTTKKVTVVTQFIKGSDGKLSEIKRLYVQNGKVIGNPQSEIANNPGSSVTDSFCKAQKVAFNDPDDFNKKGGWSGMSDALAKPMVLVMSLWHDHYANMLWLDSTYPKGSKTPGSARGSCPEDSGDPDTLEKEVPNSGVSFSNIKFGPIGSTYTGTGGSNPDPEEPEEPEEPVGTVPQYGQCGGINYSGPTACVSPYKCNKINDFYSQCQ

SEQ ID NO: 80 - protein, 437 aa, Talaromyces emersonii
EQAGTATAENHPPLTWQECTAPGSCTTQNGAVVLDANWRWVHDVNGYTNCYTGNTWDPTYCPDDETCAQNCALDGADYEGTYGVTSSGSSLKLNFVTGSNVGSRLYLLQDDSTYQIFKLLNREFSFDVDVSNLPCGLNGALYFVAMDADGGVSKYPNNKAGAKYGTGYCDSQCPRDLKFIDGEANVEGWQPSSNNANTGIGDHGSCCAEMDVWEANSISNAVTPHPCDTPGQTMCSGDDCGGTYSNDRYAGTCDPDGCDFNPYRMGNTSFYGPGKIIDTTKPFTVVTQFLTDDGTDTGTLSEIKRFYIQNSNVIPQPNSDISGVTGNSITTEFCTAQKQAFGDTDDFSQHGGLAKMGAAMQQGMVLVMSLWDDYAAQMLWLDSDYPTDADPTTPGIARGTCPTDSGVPSDVESQSPNSYVTYSNIKFGPINSTFTAS

SEQ ID NO: 81 - protein, 458 aa, Polyporus arcularius
MFPTLALVSLSFLAIAYGQQVGTLTAETHPKLSVSQCTAGGSCTTVQRSVVLDSNWRWLHDVGGSTNCYTGNTWDDSLCPDPTTCAANCALDGADYSGTYGITTSGNALSLKFVTQGPYSTNIGSRVYLLSEDDSTYEMFNLKNQEFTFDVDMSALPCGLNGALYFVEMDKDGGSGRFPTNKAGSKYGTGYCDTQCPHDIKFINGEANVLDWAGSSNDPNAGTGHYGTCCNEMDIWEANSMGAAVTPHVCTVQGQTRCEGTDCGDGDERYDGICDKDGCDFNSWRMGDQTFLGPGKTVDTSSKFTVVTQFITADNTTSGDLSEIRRLYVQNGKVIANSKTQIAGMDAYDSITDDFCNAQKTTFGDTNTFEQMGGLATMGDAFETGMVLVMSIWDDHEAKMLWLDSDYPTDADASAPGVSRGPCPTTSGDPTDVESQSPGATVIFSNIKTGPIGSTFTS

SEQ ID NO: 82 - protein, 447 aa, Leptosphaeria maculans
MLSASKAAAILAFCAHTASAWVVGDQQTETHPKLNWQRCTGKGRSSCTNVNGEVVIDANWRWLAHRSGYTNCYTGSEWNQSACPNNEACTKNCAIEGSDYAGTYGITTSGNQMNIKFITKRPYSTNIGARTYLMKDEQNYEMFQLIGNEFTFDVDLSQRCGMNGALYFVSMPQKGQGAPGAKYGTGYCDAQCARDLKFVRGSANAEGWTKSASDPNSGVGKKGACCAQMDVWEANSAATALTPHSCQPAGYSVCEDTNCGGTYSEDRYAGTCDANGCDFNPFRVGVKDFYGKGKTVDTTKKMTVVTQFVGSGNQLSEIKRFYVQDGKVIANPEPTIPGMEWCNTQKKVFQEEAYPFNEFGGMASMSEGMSQGMVLVMSLWDDHYANMLWLDSNWPREADPAKPGVARRDCPTSGGKPSEVEAANPNAQVMFSNIKFGPIGSTFAHAA

SEQ ID NO: 83 - protein, 516 aa, Phanerochaete chrysosporium
MFRTATLLAFTMAAMVFGQQVGTNTARSHPALTSQKCTKSGGCSNLNTKIVLDANWRWLHSTSGYTNCYTGNQWDATLCPDGKTCAANCALDGADYTGTYGITASGSSLKLQFVTGSNVGSRVYLMADDTHYQMFQLLNQEFTFDVDMSNLPCGLNGALYLSAMDADGGMAKYPTNKAGAKYGTGYCDSQCPRDIKFINGEANVEGWNATSANAGTGNYGTCCTEMDIWEANNDAAAYTPHPCTTNAQTRCSGSDCTRDTGLCDADGCDFNSFRMGDQTFLGKGLTVDTSKPFTVVTQFITNDGTSAGTLTEIRRLYVQNGKVIQNSSVKIPGIDPVNSITDNFCSQQKTAFGDTNYFAQHGGLKQVGEALRTGMVLALSIWDDYAANMLWLDSNYPTNKDPSTPGVARGTCATTSGVPAQIEAQSPNAYVVFSNIKFGDLNTTYTGTVSSSSVSSSHSSTSTSSSHSSSSTPPTQPTGVTVPQWGQCGGIGYTGSTTCASPYTCHVLNPYYSQCY

SEQ ID NO: 84 - protein, 453 aa, Penicillium decumbens
MYQRALLFSALMAGVSAQQVGTQKPETHPPLAWKECTSSGCTSKDGSVVIDANWRWVHSVDGYKNCYTGNEWDSTLCPDDATCATNCAVDGADYAGTYGATTEGDSLSINFVTGSNIGSRFYLMEDENKYQMFKLLNKEFTFDVDVSTLPCGLNGALYFVSMDADGGMSKYETNKAGAKYGTGYCDSQCPRDLKFINGKGNVEGWKPSANDKNAGVGPHGSCCAEMDIWEANSISTALTPHPCDTNGQTICEGDSCGGTYSTTRYAGTCDPDGCDFNPFRMGNESFYGPGKMVDTKSKMTVVTQFITSDGTDTGSLKEIKRVYVQNGKVIANSASDVSGITGNSITSDFCTAQKKTFGDEDVFNKHGGLSGMGDALGEGMVLVMSLWDDHNSNMLWLDGEKYPTDAAASKAGVSRGTCSTDSGKPSTVESESGSAKVVFSNIKVGSIGSTFSA

SEQ ID NO: 85 - protein, 450 aa, Sclerotinia sclerotiorum
MTSKIALASLFAAAYGQQIGTYTTETHPSLTWQSCTAKGSCTTQSGSIVLDGNWRWTHSTTSSTNCYTGNTWDATLCPDDATCAQNCALDGADYSGTYGITTSGDSLRLNFVTQTANKNVGSRVYLLADNTHYKTFNLLNQEFTFDVDVSNLPCGLNGAVYFANLPADGGISSTNKAGAQYGTGYCDSQCPRDGKFINGKANVDGWVPSSNNPNTGVGNYGSCCAEMDIWEANSISTAVTPHSCDTVTQTVCTGDNCGGTYSTTRYAGTCDPDGCDFNPYRQGNESFYGPGKTVDTNSVFTIVTQFLTTDGTSSGTLNEIKRFYVQNGKVIPNSESTISGVTGNSITTPFCTAQKTAFGDPTSFSDHGGLASMSAAFEAGMVLVLSLWDDYYANMLWLDSTYPTTKTGAGGPRGTCSTSSGVPASVEASSPNAYVVYSNIKVGAINSTFG

SEQ ID NO: 86 - protein, 523 aa, Acremonium thermophilum
MYTKFAALAALVATVRGQAACSLTAETHPSLQWQKCTAPGSCTTVSGQVTIDANWRWLHQTNSSTNCYTGNEWDTSICSSDTDCATKCCLDGADYTGTYGVTASGNSLNLKFVTQGPYSKNIGSRMYLMESESKYQGFTLLGQEFTFDVDVSNLGCGLNGALYFVSMDLDGGVSKYTTNKAGAKYGTGYCDSQCPRDLKFINGQANIDGWQPSSNDANAGLGNHGSCCSEMDIWEANKVSAAYTPHPCTTIGQTMCTGDDCGGTYSSDRYAGICDPDGCDFNSYRMGDTSFYGPGKTVDTGSKFTVVTQFLTGSDGNLSEIKRFYVQNGKVIPNSESKIAGVSGNSITTDFCTAQKTAFGDTNVFEERGGLAQMGKALAEPMVLVLSVWDDHAVNMLWLDSTYPTDSTKPGAARGDCPITSGVPADVESQAPNSNVIYSNIRFGPINSTYTGTPSGGNPPGGGTTTTTTTTTSKPSGPTTTTNPSGPQQTHWGQCGGQGWTGPTVCQSPYTCKYSNDWYSQCL

SEQ ID NO: 87 - protein, 446 aa, Aspergillus nidulans
MYQRALLFSALLSVSRAQQAGTAQEEVHPSLTWQRCEASGSCTEVAGSVVLDSNWRWTHSVDGYTNCYTGNEWDATLCPDNESCAQNCAVDGADYEATYGITSNGDSLTLKFVTGSNVGSRVYLMEDDETYQMFDLLNNEFTFDVDVSNFPCGLNGALYFTSMDADGGLSKYEGNTAGAKYGTGYCDSQCPRDIKFINGLGNVEGWEPSDSDANAGVGGMGTCCPEMDIWEANSISTAYTPHPCDSVEQTMCEGDSCGGTYSDDRYGGTCDPDGCDFNSYRMGNTRFYGPGAIIDTSSKFTVVTQFIADGGSLSEIKRFYVQNGEVIPNSESNISGVEGNSITSEFCTAQKTAFGDEDIFAQHGGLSAMGDAASAMVLILSIWDDHHSSMMWLDSSYPTDADPSQPGVARGTCEQGAGDPDVVESEHADASVTFSNIKFGPIGSTF

SEQ ID NO: 88 - protein, 453 aa, Podospora anserine
MMMKQYLQYLAAGSLMTGLVAGQGVGTQQTETHPRITWKRCTGKANCTTVQAEVVIDSNWRWIHTSGGTNCYDGNAWNTAACSTATDCASKCLMEGAGNYQQTYGASTSGDSLTLKFVTKHEYGTNVGSRFYLMNGASKYQMFTLMNNEFTFDVDLSTVECGLNSALYFVAMEEDGGMRSYPTNKAGAKYGTGYCDAQCARDLKFVGGKANIEGWRESSNDENAGVGPYGGCCAEIDVWESNAHAYAFTPHACENNNYHVCERDTCGGTYSEDRFAGGCDANGCDYNPYRMGNPDFYGKGKTVDTTKKFTVVTRFQDDNLEQFFVQNGQKILAPAPTFDGIPASPNLTPEFCSTQFDVFTDRNRFREVGDFPQLNAALRIPMVLVMSIWADHYANMLWLDSVYPPEKEGEPGAARGPCAQDSGVPSEVKANYPNAKVVWSNIRFGPIGSTVNV

SEQ ID NO: 89 - protein, 457 aa, Thermoascus aurantiacus
MYQRALLFSFFLAAARAQQAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGGLSKYPGNKAGAKYGTGYCDSQCPRDLKFINGQANVEGWQPSANDPNAGVGNHGSCCAEMDVWEANSISTAVTPHPCDTPGQTMCQGDDCGGTYSSTRYAGTCDPDGCDFNPYRQGNHSFYGPGKIVDTSSKFTVVTQFITDDGTPSGTLTEIKRFYVQNGKVIPQSESTISGVTGNSITTEYCTAQKAAFGDNTGFFTHGGLQKISQALAQGMVLVMSLWDDHAANMLWLDSTYPTDADPDTPGVARGTCPTTSGVPADVESQNPNSYVIYSNIKVGPINSTFTAN

SEQ ID NO: 90 - protein, 450 aa, Pseudotrichonympha grassii
MFAIVLLGLTRSLGTGTNQAENHPSLSWQNCRSGGSCTQTSGSVVLDSNWRWTHDSSLTNCYDGNEWSSSLCPDPKTCSDNCLIDGADYSGTYGITSSGNSLKLVFVTNGPYSTNIGSRVYLLKDESHYQIFDLKNKEFTFTVDDSNLDCGLNGALYFVSMDEDGGTSRFSSNKAGAKYGTGYCDAQCPHDIKFINGEANVENWKPQTNDENAGNGRYGACCTEMDIWEANKYATAYTPHICTVNGEYRCDGSECGDTDSGNRYGGVCDKDGCDFNSYRMGNTSFWGPGLIIDTGKPVTVVTQFVTKDGTDNGQLSEIRRKYVQGGKVIENTVVNIAGMSSGNSITDDFCNEQKSAFGDTNDFEKKGGLSGLGKAFDYGMVLVLSLWDDHQVNMLWLDSIYPTDQPASQPGVKRGPCATSSGAPSDVESQHPDSSVTFSDIRFGPIDSTY

SEQ ID NO: 91 - protein, 453 aa, Aspergillus terreus
MHQRALLFSALVGAVRAQQAGTLTEEVHPPLTWQKCTADGSCTEQSGSVVIDSNWRWLHSTNGSTNCYTGNTWDESLCPDNEACAANCALDGADYESTYGITTSGDALTLTFVTGENVGSRVYLMAEDDESYQTFDLVGNEFTFDVDVSNLPCGLNGALYFTSMDADGGVSKYPANKAGAKYGTGYCDSQCPRDLKFINGMANVEGWTPSDNDKNAGVGGHGSCCPELDIWEANSISSAFTPHPCDDLGQTMCSGDDCGGTYSETRYAGTCDPDGCDFNAYRMGNTSYYGPDKIVDTNSVMTVVTQFIGDGGSLSEIKRLYVQNGKVIANAQSNVDGVTGNSITSDFCTAQKTAFGDQDIFSKHGGLSGMGDAMSAMVLILSIWDDHNSSMMWLDSTYPEDADASEPGVARGTCEHGVGDPETVESQHPGATVTFSKIKFGPIGSTYSSNSTA

SEQ ID NO: 92 - protein, 540 aa, Phanerochaete chrysosporium
MFRAAALLAFTCLAMVSGQQAGTNTAENHPQLQSQQCTTSGGCKPLSTKVVLDSNWRWVHSTSGYTNCYTGNEWDTSLCPDGKTCAANCALDGADYSGTYGITSTGTALTLKFVTGSNVGSRVYLMADDTHYQLLKLLNQEFTFDVDMSNLPCGLNGALYLSAMDADGGMSKYPGNKAGAKYGTGYCDSQCPKDIKFINGEANVGNWTETGSNTGTGSYGTCCSEMDIWEANNDAAAFTPHPCTTTGQTRCSGDDCARNTGLCDGDGCDFNSFRMGDKTFLGKGMTVDTSKPFTVVTQFLTNDNTSTGTLSEIRRIYIQNGKVIQNSVANIPGVDPVNSITDNFCAQQKTAFGDTNWFAQKGGLKQMGEALGNGMVLALSIWDDHAANMLWLDSDYPTDKDPSAPGVARGTCATTSGVPSDVESQVPNSQVVFSNIKFGDIGSTFSGTSSPNPPGGSTTSSPVTTSPTPPPTGPTVPQWGQCGGIGYSGSTTCASPYTCHVLNPCESILSLQRSSNADQYLQTTRSATKRRLDTALQPRK

SEQ ID NO: 93 - protein, 504 aa, Phanerochaete chrysosporium
MRTALALILALAAFSAVSAQQAGTITAETHPTLTIQQCTQSGGCAPLTTKVVLDVNWRWIHSTTGYTNCYSGNTWDAILCPDPVTCAANCALDGADYTGTFGILPSGTSVTLRPVDGLGLRLFLLADDSHYQMFQLLNKEFTFDVEMPNMRCGSSGAIHLTAMDADGGLAKYPGNQAGAKYGTGFCSAQCPKGVKFINGQANVEGWLGTTATTGTGFFGSCCTDIALWEANDNSASFAPHPCTTNSQTRCSGSDCTADSGLCDADGCNFNSFRMGNTTFFGAGMSVDTTKLFTVVTQFITSDNTSMGALVEIHRLYIQNGQVIQNSVVNIPGINPATSITDDLCAQENAAFGGTSSFAQHGGLAQVGEALRSGMVLALSIVNSAADTLWLDSNYPADADPSAPGVARGTCPQDSASIPEAPTPSVVFSNIKLGDIGTTFGAGSALFSGRSPPGPVPGSAPASSATATAPPFGSQCGGLGYAGPTGVCPSPYTCQALNIYYSQCI

SEQ ID NO: 94 - protein, 456 aa, Thermoascus aurantiacus
MYQRALLFSFFLAAARAHEAGTVTAENHPSLTWQQCSSGGSCTTQNGKVVIDANWRWVHTTSGYTNCYTGNTWDTSICPDDVTCAQNCALDGADYSGTYGVTTSGNALRLNFVTQSSGKNIGSRLYLLQDDTTYQIFKLLGQEFTFDVDVSNLPCGLNGALYFVAMDADGNLSKYPGNKAGAKYGTGYCDSQCPRDLKFINGQANVEGWQPSANDPNAGVGNHGSSCAEMDVWEANSISTAVTPHPCDTPGQTMCQGDDCGGTYSSTRYAGTCDTDGCDFNPYQPGNHSFYGPGKIVDTSSKFTVVTQFITDDGTPSGTLTEIKRFYVQNGKVIPQSESTISGVTGNSITTEYCTAQKAAFDNTGFFTHGGLQKISQALAQGMVLVMSLWDDHAANMLWLDSTYPTDADPDTPGVARGTCPTTSGVPADVESQNPNSYVIYSNIKVGPINSTFTAN

SEQ ID NO: 95 - protein, 459 aa, Acremonium thermophilum
MHKRAATLSALVVAAAGFARGQGVGTQQTETHPKLTFQKCSAAGSCTTQNGEVVIDANWRWVHDKNGYTNCYTGNEWNTTICADAASCASNCVVDGADYQGTYGASTSGNALTLKFVTKGSYATNIGSRMYLMASPTKYAMFTLLGHEFAFDVDLSKLPCGLNGAVYFVSMDEDGGTSKYPSNKAGAKYGTGYCDSQCPRDLKFIDGKANSASWQPSSNDQNAGVGGMGSCCAEMDIWEANSVSAAYTPHPCQNYQQHSCSGDDCGGTYSATRFAGDCDPDGCDWNAYRMGVHDFYGNGKTVDTGKKFSIVTQFKGSGSTLTEIKQFYVQDGRKIENPNATWPGLEPFNSITPDFCKAQKQVFGDPDRFNDMGGFTNMAKALANPMVLVLSLWDDHYSNMLWLDSTYPTDADPSAPGKGRGTCDTSSGVPSDVESKNGDATVIYSNIKFGPLDSTYTAS

SEQ ID NO: 96 - protein, 536 aa, Volvariella volvacea
MRASLLAFSLNSAAGQQAGTLQTKNHPSLTSQKCRQGGCPQVNTTIVLDANWRWTHSTSGSTNCYTGNTWQATLCPDGKTCAANCALDGADYTGTYGVTTSGNSLTLQFVTQSNVGARLGYLMADDTTYQMFNLLNQEFWFDVDMSNLPCGLNGALYFSAMARTAAWMPMVVCASTPLISTRRSTARLLRLPVPPRSRYGRGICDSQCPRDIKFINGEANVQGWQPSPNDTNAGTGNYGACCNKMDVWEANSISTAYTPHPCTQRGLVRCSGTACGGGSNRYGSICDHDGLGFQNLFGMGRTRVRARVGRVKQFNRSSRVVEPISWTKQTTLHLGNLPWKSADCNVQNGRVIQNSKVNIPGMPSTMDSVTTEFCNAQKTAFNDTFSFQQKGGMANMSEALRRGMVLVLSIWDDHAANMLWLDSITSAAACRSTPSEVHATPLRESQIRSSHSRQTRYVTFTNIKFGPFNSTGTTYTTGSVPTTSTSTGTTGSSTPPQPTGVTVPQGQCGGIGYTGPTTCASPTTCHVLNPYYSQCY

SEQ ID NO: 97 - protein, 450 aa, Chaetomium globosum
MKQYLQYLAAALPLMSLVSAQGVGTSTSETHPKITWKKCSSGGSCSTVNAEVVIDANWRWLHNADSKNCYDGNEWTDACTSSDDCTSKCVLEGAEYGKTYGASTSGDSLSLKFLTKHEYGTNIGSRFYLMNGASKYQMFTLMNNEFAFDVDLSTVECGLNSALYFVAMEEDGGMASYSTNKAGAKYGTGYCDAQCARDLKFVGGKANYDGWTPSSNDANAGVGALGGCCAEIDVWESNAHAFAFTPHACENNNYHVCEDTTCGGTYSEDRFAGDCDANGCDYNPYRVGNTDFYGKGMTVDTSKKFTVVSQFQENKLTQFFVQNGKKIEIPGPKHEGLPTESSDITPELCSAMPEVFGDRDRFAEVGGFDALNKALAVPMVLVMSIWDDHYANMLWLDSSYPPEKAGTPGGDRGPCAQDSGVPSEVESQYPDATVVWSNIRFGPIGSTVQV

SEQ ID NO: 98 - protein, 517 aa, Irpex lacteus
MFPKASLIALSFIAAVYGQQVGTQMAEVHPKLPSQLCTKSGCTNQNTAVVLDANWRWLHTTSGYTNCYTGNSWDATLCPDATTCAQNCAVDGADYSGTYGITTSGNALTLKFKTGTNVGSRVYLMQTDTAYQMFQLLNQEFTFDVDMSNLPCGLNGALYLSQMDQDGGLSKFPTNKAGAKYGTGYCDSQCPHDIKFINGMANVAGWAGSASDPNAGSGTLGTCCSEMDIWEANNDAAAFTPHPCSVDGQTQCSGTQCGDDDERYSGLCDKDGCDFNSFRMGDKSFLGKGMTVDTSRKFTVVTQFVTTDGTTNGDLHEIRRLYVQDGKVIQNSVVSIPGIDAVDSITDNFCAQQKSVFGDTNYFATLGGLKKMGAALKSGMVLAMSVWDDHAASMQWLDSNYPADGDATKPGVARGTCSADSGLPTNVESQSASASVTFSNIKWGDINTTFTGTGSTSPSSPAGPVSSSTSVASQPTQPAQGTVAQWGQCGGTGFTGPTVCASPFTCHVVNPYYSQCY

SEQ ID NO: 99 - protein, 516 aa, Lentinula edodes
MFRTAALLSFAYLAVVYGQQAGTSTAETHPPLTWEQCTSGGSCTTQSSSVVLDSNWRWTHVVGGYTNCYTGNEWNTTVCPDGTTCAANCALDGADYEGTYGISTSGNALTLKFVTASAQTNVGSRVYLMAPGSETEYQMFNPLNQEFTFDVDVSALPCGLNGALYFSEMDADGGLSEYPTNKAGAKYGTGYCDSQCPRDIKFIEGKANVEGWTPSSTSPNAGTGGTGICCNEMDIWEANSISEALTPHPCTAQGGTACTGDSCSSPNSTAGICDQAGCDFNSFRMGDTSFYGPGLTVDTTSKITVVTQFITSDNTTTGDLTAIRRIYVQNGQVIQNSMSNIAGVTPTNEITTDFCDQQKTAFGDTNTFSEKGGLTGMGAAFSRGMVLVLSIWDDDAAEMLWLDSTYPVGKTGPGAARGTCATTSGQPDQVETQSPNAQVVFSNIKFGAIGSTFSSTGTGTGTGTGTGTGTGTTTSSAPAATQTKYGQCGGQGWTGATVCASGSTCTSSGPYYSQCL

SEQ ID NO: 100 - protein, 523 aa, Pleurotus sp.
MFRTAALTAFTFAAVVLGQQVGTLTTENHPALSIQQCTATGCTTQQKSVVLDSNWRWTHSTAGATNCYTGNAWDPALCPDPATCATNCAIDGADYSGTYGITTSGNALTLRFVTNGQYSQNIGSRVYLLDDADHYKLFDLKNQEFTFDVDMSGLPCGLNGALYFSEMAADGGKAAHAGNNAGAKYGTGYCDAQCPHDIKWINGEANVLDWSASATDDNAGNGRYGACCAEMDIWEANSEATAYTPHVCRDEGLYRCSGTECGDGNNRYGGVCDKDGCDFNSYRMGDKNFLGRGKTIDTTKKVTVVTQFITDNNTPTGNLVEIRRVYVQNGVVYQNSFSTFPSLSQYNSISDEFCVAQKTLFGDNQYYNTHGGTTKMGDAFDNGMVLIMSLWSDHAAHMLWLDSDYPLDKSPSEPGVSRGACPTSSGDPDDVVANHPNASVTFSNIKYGPIGSTFGGSTPPVSSGGSSVPPVTSTTSSGTTTPTGPTGTVPKWGQCGGIGYSGPTACVAGSTCTYSNDWYSQCL

SEQ ID NO: 101 - protein, 507 aa, Fusarium venenatum
MYRAIATASALIAAVRAQQVCSLTPETKPALSWSKCTSSGCSNVQGSVTIDANWRWTHQLSGSTNCYTGNKWDTSICTSGKVCAEKCCIDGAEYASTYGITSSGNQLSLSFVTKGTYGTNIGSRTYLMEDENTYQMFQLLGNEFTFDVDVSNIGCGLNGALYFVSMDADGGKAKYPGNKAGAKYGTGYCDAQCPRDVKFINGQANSDGWQPSKSDVNGGIGNLGTCCPEMDIWEANSISTAHTPHPCTKLTQHSCTGDSCGGTYSEDRYGGTCDADGCDFNAYRQGNKTFYGPGSGFNVDTTKKVTVVTQFHKGSNGRLSEITRLYVQNGKVIANSESKIAGVPGSSLTPEFCTAQKKVFGDIDDFEKKGAWGGMSDALEAPMVLVMSLWHDHHSNMLWLDSTYPTDSTKLGAQRGSCSTSSGVPADLEKNVPNSKVAFSNIKFGPIGSTYKEGQPEPTNPTNPNPTTPGGTVDQWGQCGGTNYSGPTACKSPFTCKKINDFYSQCQ

SEQ ID NO: 102 - protein, 516 aa, Phanerochaete chrysosporium
MFRTATLLAFTMAAMVFGQQVGTNTAENHRTLTSQKCTKSGGCSNLNTKIVLDANWRWLHSTSGYTNCYTGNQWDATLCPDGKTCAANCALDGADYTGTYGITASGSSLKLQFVTGSNVGSRVYLMADDTHYQMFQLLNQEFTFDVDMSNLPCGLNGALYLSAMDADGGMAKYPTNKAGAKYGTGYCDSQCPRDIKFINGEANVEGWNATSANAGTGNYGTCCTEMDIWEANNDAAAYTPHPCTTNAQTRCSGSDCTRDTGLCDADGCDFNSFRMGDQTFLGKGLTVDTSKPFTVVTQFITNDGTSAGTLTEIRRLYVQNGKVIQNSSVKIPGIDLVNSITDNFCSQQKTAFGDTNYFAQHGGLKQVGEALRTGMVLALSIWDDYAANMLWLDSNYPTNKDPSTPGVARGTCATTSGVPAQIEAQSPNAYVVFSNIKFGDLNTTYTGTVSSSSVSSSHSSTSTSSSHSSSSTPPTQPTGVTVPQWGQCGGIGYTGSTTCASPYTCHVLNPYYSQCY

SEQ ID NO: 103 - protein, 464 aa, Fusicoccum sp.
MYQTSLLASLSFLLATSQAQQVGTQTAETHPKLTTQKCTTAGGCTDQSTSIVLDANWRWLHTVDGYTNCYTGQEWDTSICTDGKTCAEKCALDGADYESTYGISTSGNALTMNFVTKSSQTNIGGRVYLLAADSDDTYELFKLKNQEFTFDVDVSNLPCGLNGALYFSEMDSDGGLSKYTTNKAGAKYGTGYCDTQCPHDIKFINGEANVQNWTASSTDKNAGTGHYGSCCNEMDIWEANSQATAFTPHVCEAKVEGQYRCEGTECGDGDNRYGGVCDKDGCDFNSYRMGNETFYGSNGSTIDTTKKFTVVTQFITADNTATGALTEIRRKYVQNDVVIENSYADYETLSKFNSITDDFCAAQKTLSGDTNDFKTKGGIARMGESFERGMVLVMSVWDDHAANALWLDSSYPTDADASKPGVKRGPCSTSSGVPSDVEANDADSSVIYSNIRYGDIGSTFNKTA

SEQ ID NO: 104 - protein, 460 aa, Coprinopsis cinerea
MFSKVALTALCFLAVAQAQQVGREVAENHPRLPWQRCTRNGGCQTVSNGQVVLDANWRWLHVTDGYTNCYTGNAWNSSVCSDGATCAQRCALEGANYQQTYGITTSGDALTIKFLTRSEQTNIGARVYLMENEDRYQMFNLLNKEFTFDVDVSKVPCGINGALYFIQMDADGGLSSQPNNRAGAKYGTGYCDSQCPRDIKFINGEANSVGWEPSETDPNAGKGQYGICCAEMDIWEANSISNAYTPHPCQTVNDGGYQRCQGRDCNQPRYEGLCDPDGCDYNPFRMGNKDFYGPGKTVDTNRKMTVVTQFITHDNTDTGTLVDIRRLYVQDGRVIANPPTNFPGLMPAHDSITQEFCDDAKRAFEDNDSFGRNGGLAHMGRSLAKGHVLALSIWNDHTAHMLWLDSNYPTDADPNKPGIARGTCPTTGGSPRDTEQNHPDAQVIFSNIKFGDIGSTFSGN

SEQ ID NO: 105 - protein, 505 aa, Trichoderma harzianum
MYRKLAVISAFLAAARAQQVCTQQAETHPPLTWQKCTASGCTPQQGSVVLDANWRWTHDTKSTTNCYDGNTWSSTLCPDDATCAKNCCLDGANYSGTYGVTTSGDALTLQFVTASNVGSRLYLMANDSTYQEFTLSGNEFSFDVDVSQLPCGLNGALYFVSMDADGGQSKYPGNAAGAKYGTGYCDSQCPRDLKFINGQANVEGWEPSSNNANTGVGGHGSCCSEMDIWEANSISEALTPHPCETVGQTMCSGDSCGGTYSNDRYGGTCDPDGCDWNPYRLGNTSFYGPGSSFALDTTKKLTVVTQFATDGSISRYYVQNGVKFQQPNAQVGSYSGNTINTDYCAAEQTAFGGTSFTDKGGLAQINKAFQGGMVLVMSLWDDYAVNMLWLDSTYPTNATASTPGAKRGSCSTSSGVPAQVEAQSPNSKVIYSNIRFGPIGSTGGNTGSNPPGTSTTRAPPSSTGSSPTATQTHYGQCGGTGWTGPTRCASGYTCQVLNPFYSQCL

SEQ ID NO: 106 - protein, 516 aa, Neurospora crassa
MRASLLAFSLAAAVAGGQQAGTLTAKRHPSLTWQKCTRGGCPTLNTTMVLDANWRWTHATSGSTKCYTGNKWQATLCPDGKSCAANCALDGADYTGTYGITGSGWSLTLQFVTDNVGARAYLMADDTQYQMLELLNQELWFDVDMSNIPCGLNGALYLSAMDADGGMRKYPTNKAGAKYATGYCDAQCPRDLKYINGIANVEGWTPSTNDANGIGDHGSCCSEMDIWEANKVSTAFTPHPCTTIEQHMCEGDSCGGTYSDDRYGVLCDADGCDFNSYRMGNTTFYGEGKTVDTSSKFTVVTQFIKDSAGDLAEIKAFYVQNGKVIENSQSNVDGVSGNSITQSFCKSQKTAFGDIDDFNKKGGLKQMGKALAQAMVLVMSIWDDHAANMLWLDSTYPVPKVPGAYRGSGPTTSGVPAEVDANAPNSKVAFSNIKFGHLGISPFSGGSSGTPPSNPSSSASPTSSTAKPSSTSTASNPSGTGAAHWAQCGGIGFSGPTTCPEPYTCAKDHDIYSQCV

SEQ ID NO: 107 - protein, 530 aa, Neosartorya fischeri
MLASTFSYRMYKTALILAALLGSGQAQQVGTSQAEVHPSMTWQSCTAGGSCTTNNGKVVIDANWRWVHKVGDYTNCYTGNTWDKTLCPDDATCASNCALEGANYQSTYGATTSGDSLRLNFVTTSQQKNIGSRLYMMKDDTTYEMFKLLNQEFTFDVDVSNLPCGLNGALYFVAMDADGGMSKYPTNKAGAKYGTGYCDSQCPRDLKFINGQANVEGWQPSSNDANAGTGNHGSCCAEMDIWEANSISTAFTPHPCDTPGQVMCTGDACGGTYSSDRYGGTCDPDGCDFNSFRQGNKTFYGPGMTVDTKSKFTVVTQFITDDGTASGTLKEIKRFYVQNGKVIPNSESTWSGVGGNSITNDYCTAQKSLFKDQNVFAKHGGMEGMGAALAQGMVLVMSLWDDHAANMLWLDSNYPTTASSSTPGVARGTCDISSGVPADVEANHPDASVVYSNIKVGPIGSTFNSGGSNPGGGTTTTAKPTTTTTTAGSPGGTGVAQHYGQCGGNGWQGPTTCASPYTCQKLNDFYSQCL

SEQ ID NO: 108 - protein, 451 aa, Chaetomium thermophilum
MQIKQYLQYLAAALPLVNMAAAQRAGTQQTETHPRLSWKRCSSGGNCQTVNAEIVIDANWRWLHDSNYQNCYDGNRWTSACSSATDCAQKCYLEGANYGSTYGVSTSGDALTLKFVTKHEYGTNIGSRVYLMNGSDKYQMFTLMNNEFAFDVDLSKVECGLNSALYFVAMEEDGGMRSYSSNKAGAKYGTGYCDAQCARDLKFVGGKANIEGWRPSTNDANAGVGPYGACCAEIDVWESNAYAFAFTPHGCLNNNYHVCETSNCGGTYSEDRFGGLCDANGCDYNPYRMGNKDFYGKGKTVDTSRKFTVVTRFEENKLTQFFIQDGRKIDIPPPTWPGLPNSSAITPELCTNLSKVFDDRDRYEETGGFRTINEALRIPMVLVMSIWDGHYASMLWLDSVYPPEKAGQPGAERGPCAPTSGVPAEVEAQFPNAQVIWSNIRFGPIGSTYQV

SEQ ID NO: 109 - protein, 450 aa, Botryotinia fuckeliana
MTSRIALVSLFAAVYGQQVGTYQTETHPSLTWQSCTAKGSCTTNTGSIVLDGNWRWTHGVGTSTNCYTGNTWDATLCPDDATCAQNCALEGADYSGTYGITTSGNSLRLNFVTQSANKNIGSRVYLMADTTHYKTFNLLNQEFTFDVDVSNLPCGLNGAVYFANLPADGGISSTNTAGAEYGTGYCDSQCPRDMKFIKGQANVDGWVPSSNNANTGVGNHGSCCAEMDIWEANSISTAVTPHSCDTVTQTVCTGDDCGGTYSSSRYAGTCDPDGCDFNSYRMGDETFYGPGKTVDTNSVFTVVTQFLTTDGTASGTLNEIKRFYVQDGKVIPNSYSTISGVSGNSITTPFCDAQKTAFGDPTSFSDHGGLASMSAAFEAGMVLVLSLWDDYYANMLWLDSTYPVGKTSAGGPRGTCDTSSGVPASVEASSPNAYVVYSNIKVGAINSTYG

SEQ ID NO: 110 - protein, 450 aa, Pseudotrichonympha grassii
MFVFVLLWLTQSLGTGTNQAENHPSLSWQNCRSGGSCTQTSGSVVLDSNWRWTHDSSLTNCYDGNEWSSSLCPDPKTCSDNCLIDGADYSGTYGITSSGNSLKLVFVTNGPYSTNIGSRVYLLKDESHYQIFDLKNKEFTFTVDDSNLDCGLNGALYFVSMDEDGGTSRFSSNKAGAKYGTGYCDAQCPHDIKFINGEANVENWKPQTNDENAGNGRYGACCTEMDIWEANKYATAYTPHICTVNGEYRCDGSECGDTDSGNRYGGVCDKDGCDFNSYRMGNTSFWGPGLIIDTGKPVTVVTQFVTKDGTDNGQLSEIRRKYVQGGKVIENTVVNIAGMSSGNSITDDFCNEQKSAFGDTNDFEKKGGLSGLGKAFDYGMVLVLSLWDDHQVNMLWLDSIYPTDQPASQPGVKRGPCATSSGAPSDVESQHPDSSVTFSDIRFGPIDSTY

SEQ ID NO: 111 - protein, 523 aa, Irpex lacteus
MFRKAALLAFSFLAIAHGQQVGTNQAENHPSLPSQKCTASGCTTSSTSVVLDANWRWVHTTTGYTNCYTGQTWDASICPDGVTCAKACALDGADYSGTYGITTSGNALTLQFVKGTNVGSRVYLLQDASNYQMFQLINQEFTFDVDMSNLPCGLNGAVYLSQMDQDGGVSRFPTNTAGAKYGTGYCDSQCPRDIKFINGEANVEGWTGSSTDSNSGTGNYGTCCSEMDIWEANSVAAAYTPHPCSVNQQTRCTGADCGQGDDRYDGVCDPDGCDFNSFRMGDQTFLGKGLTVDTSRKFTIVTQFISDDGTTSGNLAEIRRFYVQDGNVIPNSKVSIAGIDAVNSITDDFCTQQKTAFGDTNRFAAQGGLKQMGAALKSGMVLALSLWDDHAANMLWLDSDYPTTADASNPGVARGTCPTTSGFPRDVESQSGSATVTYSNIKWGDLNSTFTGTLTTPSGSSSPSSPASTSGSSTSASSSASVPTQSGTVAQWAQCGGIGYSGATTCVSPYTCHVVNAYYSQCY

SEQ ID NO: 112 - protein, 513 aa, Gibberella avenacea
MYRAIATASALIAAARAQQVCTLTTETKPALTWSKCTSSGCTDVKGSVGIDANWRWTHQTSSSTNCYTGNKWDTSVCTSGETCAQKCCLDGADYAGTYGITSSGNQLSLGFVTKGSFSTNIGSRTYLMENENTYQMFQLLGNEFTFDVDVSNIGCGLNGALYFVSMDADGGKARYPANKAGAKYGTGYCDAQCPRDVKFINGKANSDGWKPSDSDINAGIGNMGTCCPEMDIWEANSISTAFTPHPCTKLTQHACTGDSCGGTYSNDRYGGTCDADGCDFNSYRQGNKTFYGRGSDFNVDTTKKVTVVTQFKKGSNGRLSEITRLYVQNGKVIANSESKIPGNSGSSLTADFCSKQKSVFGDIDDFSKKGGWSGMSDALESPPMVLVMSLWHDHHSNMLWLDSTYPTDSTKLGAQRGSCATTSGVPSDLERDVPNSKVSFSNIKFGPIGSTYSSGTTNPPPSSTDTSTTPTNPPTGGTVGQYGQCGGQTYTGPKDCKSPYTCKKINDFYSQCQ

SEQ ID NO: 113 - protein, 536 aa, Aspergillus niger
MSSFQIYRAALLLSILATANAQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGQEFTFDVDVSNLPCGLNGALYFVAMDADGGTSEYSGNKAGAKYGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGSGSSSSSSSTTTKATSTTLKTTSTTSSGSSSTSAAQAYGQCGGQGWTGPTTCVSGYTCTYENAYYSQCL

SEQ ID NO: 114 - protein, 452 aa, Aspergillus niger
MHQRALLFSALLTAVRAQQAGTLTEEVHPSLTWQKCTSEGSCTEQSGSVVIDSNWRWTHSVNDSTNCYTGNTWDATLCPDDETCAANCALDGADYESTYGVTTDGDSLTLKFVTGSNVGSRLYLMDTSDEGYQTFNLLDAEFTFDVDVSNLPCGLNGALYFTAMDADGGVSKYPANKAGAKYGTGYCDSQCPRDLKFIDGQANVDGWEPSSNNDNTGIGNHGSCCPEMDIWEANKISTALTPHPCDSSEQTMCEGNDCGGTYSDDRYGGTCDPDGCDFNPYRMGNDSFYGPGKTIDTGSKMTVVTQFITDGSGSLSEIKRYYVQNGNVIANADSNISGVTGNSITTDFCTAQKKAFGDEDIFAEHNGLAGISDAMSSMVLILSLWDDYYASMEWLDSDYPENATATDPGVARGTCDSESGVPATVEGAHPDSSVTFSNIKFGPINSTFSASA

SEQ ID NO: 115 - protein, 526 aa, Chrysosporium lucknowense
  MOD_RES (249)..(249): Any amino acid
  MOD_RES (365)..(365): Any amino acid
MYAKFATLAALVAGAAAQNACTLTAENHPSLTWSKCTSGGSCTSVQGSITIDANWRWTHRTDSATNCYEGNKWDTSYCSDGPSCASKCCIDGADYSSTYGITTSGNSLNLKFVTKGQYSTNIGSRTYLMESDTKYQMFQLLGNEFTFDVDVSNLGCGLNGALYFVSMDADGGMSKYSGNKAGAKYGTGYCDSQCPRDLKFINGEANVENWQSSTNDANAGTGKYGSCCSEMDVWEANNMAAAFTPHPCXVIGQSRCEGDSCGGTYSTDRYAGICDPDGCDFNSYRQGNKTFYGKGMTVDTTKKITVVTQFLKNSAGELSEIKRFYVQNGKVIPNSESTIPGVEGNSITQDWCDRQKAAFGDVTDXQDKGGMVQMGKALAGPMVLVMSIWDDHAVNMLWLDSTWPIDGAGKPGAERGACPTTSGVPAEVEAEAPNSNVIFSNIRFGPIGSTVSGLPDGGSGNPNPPVSSSTPVPSSSTTSSGSSGPTGGTGVAKHYEQCGGIGFTGPTQCESPYTCTKLNDWYSQCL

SEQ ID NO: 116 - protein, 538 aa, Thielavia australiensis
MYAKFATLAALVAGASAQAVCSLTAETHPSLTWQKCTAPGSCTNVAGSITIDANWRWTHQTSSATNCYSGSKWDSSICTTGTDCASKCCIDGAEYSSTYGITTSGNALNLKFVTKGQYSTNIGSRTYLMESDTKYQMFKLLGNEFTFDVDVSNLGCGLNGALYFVSMDADGGMSKYSGNKAGAKYGTGYCDAQCPRDLKFINGEANVEGWESSTNDANAGSGKYGSCCTEMDVWEANNMATAFTPHPCTTIGQTRCEGDTCGGTYSSDRYAGVCDPDGCDFNSYRQGNKTFYGKGMTVDTTKKITVVTQFLKNSAGELSEIKRFYAQDGKVIPNSESTIAGIPGNSITKAYCDAQKTVFQNTDDFTAKGGLVQMGKALAGDMVLVMSVWDDHAVNMLWLDSTYPTDQVGVAGAERGACPTTSGVPSDVEANAPNSNVIFSNIRFGPIGSTVQGLPSSGGTSSSSSAAPQSTSTKASTTTSAVRTTSTATTKTTSSAPAQGTNTAKHWQQCGGNGWTGPTVCESPYKCTKQNDWYSQCL

SEQ ID NO: 117 - protein, 441 aa, Unknown
  source: /note="Description of Unknown: Uncultured symbiotic protist of Reticulitermes speratus"
MLTLVYFLLSLVVSLEIGTQQSEDHPKLTWQNGSSSVSGSIVLDSNWRWVHDSGTTNCYDGNLWSKDLCPSSDTCSQKCYIEGADYSGTYGIQSSGSKLTLKFVTKGSYSTNIGSRVYLLKDENTYESFKLKNKEFTFTVDDSKLNCGLNGALYFVAMDADGGKAKYSSFKPGAKYGMGYCDAQCPHDMKFISGKANVDDWKPQDNDENSGNGKLGTCCSEMDIWEGNMKSQAYTVHACTKSGQYECTGQQCGDTDSGDRFKGTCDKDGCDYASWRWGDQSFYGEGKTVDTKQPVTVVTQFIGDPLTEIRRLYVQGGKTINNSKTSNLADTYDSITDKFCDATKEASGDTNDFKAKGAMSGFSTNLNNGQVLVMSLWDDHTANMLWLDSTYPTDSSDSTAQRGPCPTSSGVPKDVESQHGDATVVFSDIKFGAINSTFKYN

SEQ ID NO: 118 - protein, 445 aa, Unknown
  source: /note="Description of Unknown: Uncultured symbiotic protist of Neotermes koshunensis"
MLAAALFTFACSVGVGTKTPENHPKLNWQNCASKGSCSQVSGEVTMDSNWRWTHDGNGKNCYDGNTWISSLCPDDKTCSDKCVLDGAEYQATYGIQSNGTALTLKFVTHGSYSTNIGSRLYLLKDKSTYYVFKLNNKEFTFSVDVSKLPCGLNGALYFVEMDADGGKAKYAGAKPGAEYGLGYCDAQCPSDLKFINGEANSEGWKPQSGDKNAGNGKYGSCCSEMDVWESNSQATALTPHVCKTTGQQRCSGKSECGGQDGQDRFAGLCDEDGCDFNNWRMGDKTFFGPGLIVDTKSPFVVVTQFYGSPVTEIRRKYVQNGKVIENSKSNIPGIDATAAISDHFCEQQKKAFGDTNDFKNKGGFAKLGQVFDRGMVLVLSLWDDHQVAMLWLDSTYPTNKDKSQPGVDRGPCPTSSGKPDDVESASADATVVYGNIKFGALDSTY

SEQ ID NO: 119 - protein, 441 aa, Unknown
  source: /note="Description of Unknown: Uncultured symbiotic protist of Reticulitermes speratus"
MLTLVYFLLSLVVSLEIGTQQSEDHPKLTWQNGSSSVSGSIVLDSNWRWVHDSGTTNCYDGNLWSKDLCPSSNTCSQKCYIEGADYSGTYGIQSSGSKLTLKFVTKGSYSTNIGSRVYLLKDENTYESFKLKNKEFTFTVDDSKLNCGLNGALYFVAMDADGGKAKYSSFKPGAKYGMGYCDAQCPHDMKFISGKANVDDWKPQDNDENSGNGKLGTCCSEMDIWEGNMKSQAYTVHACTKSGQYECTGQQCGDTDSGDRFKGTCDKDGCDYASWRWGDQSFYGEGKTVDTKQPVTVVTQFIGDPLTEIRRLYVQGGKTINNSKTSNLADTYDSITDKFCDATKEASGDTNDFKAKGAMSGFSTNLNNGQVLVMSLWDDHTANMLWLDSTYPTDSTKTGASRGPCAVSSGVPKDVESQYGDATVIYSDIKFGAINSTFKWN

SEQ ID NO: 120 - protein, 448 aa, Unknown
  source: /note="Description of Unknown: Uncultured symbiotic protist of Cryptocercus punctulatus"
MILALLSLAKSLGIATNQAETHPKLTWTRYQSKGSGQTVNGEIVLDSNWRWTHHSGTNCYDGNTWSTSLCPDPTTCSNNCDLDGADYPGTYGISTSGNSLKLGFVTHGSYSTNIGSRVYLLRDSKNYEMFKLKNKEFTFTVDDSKLPCGLNGALYFVAMDEDGGVSKNSINKAGAQYGTGYCDAQCPHDMKFINGEANVLDWKPQSNDENSGNGRYGACCTEMDIWEANSMATAYTPHVCTVTGLRRCEGTECGDTDANQRYNGICDKDGCDFNSYRLGDKTFFGVGKTVDSSKPVTVVTQFVTSNGQDSGTLSEIRRKYVQGGKVIENSKVNIAGITAGNSVTDTFCNEQKKAFGDNNDFEKKGGLGALSKQLDAGMVLVLSLWDDHSVNMLWLDSTYPTNAAAGALGTERGACATSSGAPSDVESQSPDATVTFSDIKFGPIDSTY

SEQ ID NO: 121 - protein, 446 aa, Unknown
  source: /note="Description of Unknown: Uncultured symbiotic protist of Hodotermopsis sjoestedti"
MLVIALILRGLSVGTGTQQSETHPSLSWQQTSKGGSGQSVSGSVVLDSNWRWTHTTDGTTNCYDGNEWSSDLCPDASTCSSNCVLEGADYSGTYGITGSGSSLKLGFVTKGSYSTNIGSRVYLLGDESHYKLFKLENNEFTFTVDDSNLECGLNGALYFVAMDEDGGASKYSGAKPGAKYGMGYCDAQCPHDMKFINGDANVEGWKPSDNDENAGTGKWGACCTEMDIWEANKYATAYTPHICTKNGEYRCEGTDCGDTKDNNRYGGVCDKDGCDFNSWRMGNQSFWGPGLIIDTGKPVTVVTQFLADGGSLSEIRRKYVQGGKVIENTVTKISGMDEFDSITDEFCNQQKKAFRDTNDFEKKGGLKGLGTAVDAGVVLVLSLWDDHDVNMLWLDSIYPTDSGSKAGADRGPCATSSGVPKDVESNYASASVTFSDIKFGPIDSTY

SEQ ID NO: 122 - protein, 448 aa, Unknown
  source: /note="Description of Unknown: Uncultured symbiotic protist of Cryptocercus punctulatus"
MLLALFAFGKSLGIATNQAENHPKLTWTRYQSKGSGQTVNGEIVLDSNWRWTHHSGTNCYDGNTWSTSLCPDPTTCSNNCDLDGADYPGTYGISSSGNSLKLGFVTHGSYSTNIGSRVYLLRDSKNYEMFKLKNKEFTFTVDDSKLPCGLNGALYFVAMDEDGGVSKNSINKAGAQYGTGYCDAQCPHDMKFINGEANVLDWKPQSNDENSGNGRYGACCTEMDIWEANSMATAYTPHVCTVTGIRRCEGTECGDTDANQRYNGICDKDGCDFNSYRLGDKSFFGVGKTVDSSKPVTVVTQFVTSNGQDSGTLSEIRRKYVQGGKVIENSKVNIAGMAAGNSITDTFCNEQKKAFGDNNDFEKKGGLGALSKQLDSGMVLVLSLWDDHSVNMLWLDSTYPTNAAAGALGTERGACATSSGAPSDVESQSPDATVTFSDIKFGPIDSTY

SEQ ID NO: 123 - protein, 451 aa, Unknown
  source: /note="Description of Unknown: Uncultured symbiotic protist of Reticulitermes speratus"
MLASVVYLVSLVVSLEIGTQQSEEHPKLTWQNGSSSVSGSIVLDSNWRWLHDSGTTNCYDGNLWSDDLCPNADTCSSKCYIEGADYSGTYGITSSGSKVTLKFVTKGSYSTNIGSRIYLLKDENTYETFKLKNKEFTFTVDDSKLDCGLNGALYFVAMDADGGKAKYSSFKPGAKYGMGYCDAQCPHDMKFISGKANVDDWKPQDNDENSGDGKLGTCCSEMDIWEGNAKSQAYTVHACSKSGQYECTGQQCGDTDSGDRFKGTCDKDGCDYASWRWGDQSFYGEGKTVDTKSPVTVVTQFIGDPLTEIRRVYVQGGKTINNSKTSNLADTYDSITDKFCDATKDATGDTNDFKAKGAMAGFSTNLNTAQVLVSVHCGMIIQPICCGLIRRIQRIQQKQVQAVDRVLCRRVFQRMLKASMVMLQSRTRTLSLELSTRPLVGISPAGRLFFF

SEQ ID NO: 124 - protein, 448 aa, Unknown
  source: /note="Description of Unknown: Uncultured symbiotic protist of Cryptocercus punctulatus"
MILALLVLGKSLGIATNQAETHPKLTWTRYQSKGSGSTVNGEIVLDSNWRWTHHSGTNCYDGNTWSTSLCPDPTTCSNNCDLDGADYPGTYGISTSGNSLKLGFVTHGSYSTNIGSRVYLLKDTKSYEMFKLKNKEFTFTVDDSKLPCGLNGALYFVAMDEDGGVSKNSINKAGAQYGTGYCDAQCPHDMKFINGEANVLDWKPQSNDENSGNGRYGACCTEMDIWEANSMATAYTPHVCTVTGLRRCEGTECGDTDNDQRYNGICDKDGCDFNSYRLGDKSFFGVGKTVDSSKPVTVVTQFVTSNGQDSGTLSEIRRKYVQGGKVIENSKVNVAGITAGNSVTDTFCNEQKKAFGDNNDFEKKGGLGALSKQLDAGMVLVLSLWDDHSVNMLWLDSTYPTNAAAGALGTERGACATSSGKPSDVESQSPDATVTFSDIKFGPIDSTY

SEQ ID NO: 125 - protein, 439 aa, Unknown
  source: /note="Description of Unknown: Uncultured symbiotic protist of Mastotermes darwiniensis"
MLCIGLISFVYSLGVGTNTAETHPKLTWKNGGQTVNGEVTVDSNWRWTHTKGSTKNCYDGNLWSKDLCPDAATCGKNCVLEGADYSGTYGVTSSGNALTLKFVTHGSYSTNVGSRLYLLKDEKTYQMFNLNGKEFTFTVDVSNLPCGLNGALYHVNMDEDGGTKRYPDNEAGAKYGTGYCDAQCPTDLKFINGIPNSDGWKPQSNDKNSGNGKYGSCCSEMDIWEANSICSAVTPHVCDNLQQTRCQGTACGENGGGSRFGSSCDPDGCDFNSWRMGNKTFYGPGLIVDTKSKFTVVTQFVGNPVTEIKRKYVQNGKVIENSYSNIEGMDKFNSVSDKFCTAQKKAFGDTDSFTKHGGFKQLGSALAKGMVLVLSLWDDHTVNMLWLDSVYPTNSKKAGSDRGPCPTTSGVPADVESKSADANVIYSDIRFGAIDSTYK

SEQ ID NO: 126 - protein, 442 aa, Unknown
  source: /note="Description of Unknown: Uncultured symbiotic protist of Neotermes koshunensis"
MLGALVALASCIGVGTNTPEKHPDLKWTNGGSSVSGSIVVDSNWRWTHIKGETKNCYDGNLWSDKYCPDAATCGKNCVLEGADYSGTYGVTTSGDAATLKFVTHGQYSTNVGSRLYLLKDEKTYQMFNLVGKEFTFTVDVSNLPCGLNGALYFVQMDSDGGMAKYPDNQAGAKYGTGYCDAQCPTDLKFINGIPNSDGWKPQKNDKNSGNGKYGSCCSEMDIWEANSMATAYTPHVCDKLEQTRCSGSACGQNGGGDRFSSSCDPDGCDFNSWRMGNKTFWGPGLIVDTKKPVQVVTQFVGSGGSVTEIKRKYVQGGKVIDNSMTNIAAMSKQYNSVSDEFCQAQKKAFGDNDSFTKHGGFRQLGATLSKGHVLVLSLWDDHDVNMLWLDSVYPTNSNKPGADRGPCKTSSGVPSDVESQNADSTVKYSDIRFGAIDSTYSK

SEQ ID NO: 127 - protein, 445 aa, Unknown
  source: /note="Description of Unknown: Uncultured symbiotic protist of Neotermes koshunensis"
MLAAALFTFACSVGVGTKTTETHPKLNWQQCACKGSCSQVSGEVTMDSNWRWTHDGNGKNCYDGNTWISSLCPDDKTCSDKCVLDGAEYQATYGIQSNGTALTPKFVTHGSYSTNIGSRLYLLKDKSTYYVFQLNNKEFTFSVDVSKLPCGLNGALYFVEMDADGGKSKYAGAKPGAEYGLGYCDAQCPSDLKFINGEANSEGWKPQSGDKNAGNGKYGSCCSEMDVWESNSMATALTPHVCKTTGQTRCSGKSECGGQDGQDRFAGNCDEDGCDFNNWRMGDKTFFGPGLTVDTKSPFVVVTQFYGSPVTEIRRKYVQNGKVIENAKSNIPGIDATNAISDTFCEQQKKAFGDTNDFKNKGGFTKLGSVFSRGMVLVLSLWDDHQVAMLWLDSTYPTNKDKSVPGVDRGPCPTSSGKPDDVESASGDATVVYGNIKFGALDSTY

SEQ ID NO: 128 - protein, 437 aa, Unknown
  source: /note="Description of Unknown: Uncultured symbiotic protist of Reticulitermes speratus"
MFGFLLSLFALQFALEIGTQTSESHPSITWELNGARQSGQIVIDSNWRWLHDSGTTNCYDGNTWSSDLCPDPEKCSQNCYLEGADYSGTYGISASGSQLTLGFVTKGSYSTNIGSRVYLLKDENTYPMFKLKNKEFTFTVDVSNLPCGLNGALYFVAMPSDGGKAKYPLAKPGAKYGMGYCDAQCPHDMKFINGEANVLDWKPQSNDENAGTGRYGTCCTEMDIWEANSQATAYTVHACSKNARCEGTECGDDSASQRYNGICDKDGCDFNSWRWGNKTFFGPGLTVDSSKPVTVVTQFIGDPLTEIRRIWVQGGKVIQNSFTNVSGITSVDSITNTFCDESKVATGDTNDFKAKGGMSGFSKALDTEVVLVLSLWDDHTANMLWLDSTYPTDSTAIGASRGPCATSSGDPKDVESASANASVKFSDIKFGALDSTY

SEQ ID NO: 129 - protein, 447 aa, Unknown
  source: /note="Description of Unknown: Uncultured symbiotic protist of Cryptocercus punctulatus"
MLASLLPLSNSLGTASNQAETHPKLTWTQYTGKGAGQTVNGEIVLDSNWRWTHKDGTNCYDGNTWSSSLCPDPTTCSNNCNLDGADYPGTYGITTSGNQLKLGFVTHGSYSTNIGSRVYLLRDSKNYQMFKLKNKEFTFTVDDSKLPCGLNGAVYFVAMDEDGGTAKHSINKAGAQYGTGYCDAQCPHDMKFINGEANVLDWKPQSNDENSGNGRWGARCTEMDIWEANSRATAYTPHICTKTGLYRCEGTECGDSDTNRYGGVCDKDGCDFNSYRMGDKSFFGQGKTVDSSKPVTVVTQFITDNNQDSGKLTEIRRKYVQGGKVIDNSKVNIAGITAGNPITDTFCDEAKKAFGDNNDFEKKGGLSALGTQLEAGFVLVLSLWDDHSVNMLWLDSTYPTNASPGALGVERGDCAITSGVPADVESQSADASVTFSDIKFGPIDSTY

SEQ ID NO: 130 - protein, 439 aa, Unknown
  source: /note="Description of Unknown: Uncultured symbiotic protist of Mastotermes darwiniensis"
MLCIGLISFVYSLGVGTNTAETHPKLTWKNGGQTVNGEVTVDSNWRWTHTKGSTKNCYDGNLWSKDLCPDAATCGKNCVLEGADYSGTYGVTSSGNALTLKFVTHGSYSTNVGSRLYLLKDEKTYQMFNLNGKEFTFTVDVSNLPCGLSGALYHVNMDEDGGTKRYPDNEAGAKYGTGYCDAQCPTDLKFINGIPNSDGWKPQSNDKNSGNGKYGSCCSEMDIWEANSICSAVTPHVCDNLQQTRCQGAACGENGGGSRFGSSCDPDGCDFNSWGMGNKTFYGPGLIVDTKSKFTVVTQFVGNPVTEIKRKYVQNGKVIENSYSNIEGMDKFNSVSDKFCTAQKKAFGDTDSFTKHGGFKQLGSALAKGMVLVLSLWDDHTVNMLWLDSVYPTNSKKAGSDRGPCPTTSGVPADVESKSADANVIYSDIRFGAIDSTYK

SEQ ID NO: 131 - protein, 448 aa, Unknown
  source: /note="Description of Unknown: Uncultured symbiotic protist of Cryptocercus punctulatus"
MILALLVLGKSLGIATNQAETHPKLTWTRYQSKGSGSTVNGEIVLDSNWRWTHHSGTNCYDGNTWSTSLCPDPTTCSNNCDLDGADYPGTYGISTSGNSLKLGFVTHGSYSTNIGSRVYLLRDSKNYEMFKLKNKEFTFTVDDSKLPCGLNGALYFVAMDEDGGVSKNSINKAGAQYGTGYCDAQCPHDMKFINGEANVLDWKPQSNDENSGNGRYGACCTEMDIWEANSMATAYTPHVCTVTGLRRCEGTECGDTDNDQRYNGICDKDGCDFNSYRLGDKSFFGVGKTVDSSKPVTVVTQFVTSNGQDSGILSETRRKYVQGGKVIENSKVNVAGITAGNSVTDTFCNEQKKAFGDNNDFEKKGGLGALSKQLDAGMVLVLSLWDDHSVNMLWLDSTYPTNAAAGALGTERGACATSSGKPSDVESQSPDATVTFSDIKFGPIDSTY

SEQ ID NO: 132 - protein, 449 aa, Unknown
  source: /note="Description of Unknown: Uncultured symbiotic protist of Hodotermopsis sjoestedti"
MIGIVLIQTVFGIGVGTQQSESHPSLSWQQCSKGGSCTSVSGSIVLDSNWRWTHIPDGTTNCYDGNEWSSDLCPDPTTCSNNCVLEGADYSGTYGISTSGSSAKLGFVTKGSYSTNIGSRVYLLGDESHYKIFDLKNKEFTFTVDDSNLECGLNGALYFVAMDEDGGASRFTLAKPGAKYGTGYCDAQCPHDIKFINGEANVQDWKPSDNDDNAGTGHYGACCTEMDIWEANKYATAYTPHICTENGEYRCEGKSCGDSSDDRYGGVCDKDGCDFNSWRLGNQSFWGPGLIIDTGKPVTVVTQFVTKDGTDSGALSEIRRKYVQGGKTIENTVVKISGIDEVDSITDEFCNQQKQAFGDTNDFEKKGGLSGLGKAFDYGVVLVLSLWDDHDVNMLWLDSVYPTNPAGKAGADRGPCATSSGDPKEVEDKYASASVTFSDIKFGPIDSTY

SEQ ID NO: 133 - protein, 439 aa, Unknown
  source: /note="Description of Unknown: Uncultured symbiotic protist of Mastotermes darwiniensis"
MLVFGIVSFVYSIGVGTNTAETHPKLTWKNGGSTTNGEVTVDSNWRWTHTKGSTKNCYDGNLWSKDLCPDAATCGKNCVLEGADYSGTYGVTSSGDALTLKFVTHGSYSTNVGSRLYLLKDEKTYQMFNLNGKEFTFTVDVSQLPCGLNGALYFVCMDQDGGMSRYPDNQAGAKYGTGYCDAQCPTDLKFINGLPNSDGWKPQSNDKNSGNGKYGSCCSEMDIWEANSLATAVTPHVCDQVGQTRCEGRACGENGGGDRFGSICDPDGCDFNSWRMGNKTFWGPGLIIDTKKPVTVVTQFIGSPVTEIKREYVQGGKVIENSYTNIEGMDKFNSISDKFCTAQKKAFGDNDSFTKHGGFSKLGQSFTKGQVLVLSLWDDHTVNMLWLDSVYPTNSKKLGSDRGPCPTSSGVPADVESKNADSSVKYSDIRFGSIDSTYK

SEQ ID NO: 134 - protein, 451 aa, Unknown
  source: /note="Description of Unknown: Uncultured symbiotic protist of Reticulitermes speratus"
MLSFVFLLGFGVSLEIGTQQSENHPTLSWQQCTSSGSCTSQSGSIVLDSNWRWVHDSGTTNCYDGNEWSSDLCPDPETCSKNCYLDGADYSGTYGITSNGSSLKLGFVTEGSYSTNIGSRVYLKKDTNTYQIFKLKNHEFTFTVDVSNLPCGLNGALYFVEMEADGGKGKYPLAKPGAQYGMGYCDAQCPHDMKFINGNANVLDWKPQETDENSGNGRYGTCCTEMDIWEANSQATAYTPHICTKDGQYQCEGTECGDSDANQRYNGVCDKDGCDFNSYRLGNKTFFGPGLIVDSKKPVTVVTQFITSNGQDSGDLTEIRRIYVQGGKTIQNSFTNIAGLTSVDSITEAFCDESKDLFGDTNDFKAKGGFTAMGKSLDTGVVLVLSLWDDHSVNMLWLDSTYPTDAAAGALGTQRGPCATSSGAPSDVESQSPDASVTFSDIKFGPLDSTY

SEQ ID NO: 135 - protein, 439 aa, Unknown
  source: /note="Description of Unknown: Uncultured symbiotic protist of Reticulitermes speratus"
MLTLVVYLLSLVVSLEIGTQQSESHPALTWQREGSSASGSIVLDSNWRWVHDSGTTNCYDGNEWSTDLCPSSDTCTQKCYIEGADYSGTYGITTSGSKLTLKFVTKGSYSTNIGSRVYLLKDENTYETFKLKNKEFTFTVDDSKLDCGLNGALYFVAMDADGGKQKYSSFKPGAKYGMGYCDAQCPHDMKFISGKANVEDWKPQDNDENSGNGKLGTCCSEMDIWEGNAKSQAYTVHACTKSGQYECTGTDCGDSDSRYQGTCDKDGCDYASYRWGDHSFYGEGKTVDTKQPITVVTQFIGDPLTEIRRLYIQGGKVINNSKTQNLASVYDSITDAFCDATKAASGDTNDFKAKGAMAGFSKNLDTPQVLVLSLWDDHTANMLWLDSTYPTDSRDATAERGPCATSSGVPKDVESNQADASVVFSDIKFGAINSTYSYN

SEQ ID NO: 136 - protein, 437 aa, Unknown
  source: /note="Description of Unknown: Uncultured symbiotic protist of Reticulitermes speratus"
MFGFLLSLFALQFALEIGTQTSESHPSITWELNGARQSGQIVIDSNWRWLHDSGTTNCYDGNTWSSDLCPDPEKCSQNCYLEGADYSGTYGISASGSQLTLGFVTKGSYSTNIGSRVYLLKDENTYQMFKLKNKEFTFTVDVSNLPCGLNGALYFVAMPSDGGKAKYPLAKPGAKYGMGYCDAQCPHDMKFINGEANVLDWKPQSNDENAGTGRYGTCCTEMDIWEANSQATAYTVHACSKNARCEGTECGDDSASQRYNGICDKDGCDFNSWRWGNKTFFGPGLTVDSSKPVTVVTQFIGDPLTEIRRIWVQGGKVIQNSFTNVSGITSVDSITNTFCDESKVATGDTNDFKAKGGMSGFSKALDTEVVLVLSLWDDHTANMLWLDSTYPSNSTAIGATRGPCATSSGDPKNVESASANASVKFSDIKFGAFDSTY

SEQ ID NO: 137 - protein, 438 aa, Unknown
  source: /note="Description of Unknown: Uncultured symbiotic protist of Reticulitermes speratus"
MLALVYFLLSLVVSLEIGTQQSEDHPKLTWQNGSSSVSGSIVLDSNWRWVHDSGTTNCYDGNLWSTDLCPSSDTCTSKCYIEGADYSGTYGITSSGSKVTLKFVTKGSYSTNIGSRIYLLKDENTYETFKLKNKEFTFTVDDSQLNCGLNGALYFVAMDADGGKAKYSSFKPGAKYGMGYCDAQCPHDMKFISGKANVDDWKPQDNDENSGNGKLGTCCSEMDIWEGNAKSQAYTVHACTKSGQYECTGQQCGDTDSGDRFKGTCDKDGCDYASWRWGDQSFYGEGKTVDTKQPVTVVTQFIGDPLTEIRRLYVQGGKTINNSKTSNLADTYDSITDKFCDATKEASGDTNDFKAKGAMSGFSTNLNTAQVLVLSLWDDHTANMLWLDSTYPTDSTKTGASRGPCAVTSGVPKDVESQYGSAQVVYSDIKFGAINSTY

SEQ ID NO: 138 - protein, 441 aa, Unknown
  source: /note="Description of Unknown: Uncultured symbiotic protist of Reticulitermes speratus"
MLALVYFLLSFVVSLEIGTQQSEDHPKLTWQNGSSSVSGSIVLDSNWRWVHDSGTTNCYDGNLWSTDLCGSSDTCSSKCYIEGADYSGTYGISASGSKLTLKFVTKGSYSTNIGSRVYLLKDENTYETFKLKGKEFTFTVDDSKLDCGLNGALYFVAMDADGGKAKYSSFKPGAKYGMGYCDAQCPHDMKFISGKANVDDWKPQDNDENSGNGKLGTCCSEMDIWEGNAKSQAYTVHACTKSGQYECTGQQCGDTDSGDRFKGTCDKDGCDYASWRWGDQSFYGEGKTIDTKQPVTVVTQFIGDPLTEIRRVYVQGGKVINNSKTSNLANVYDSITDKFCDDTKDATGDTNDFKAKGAMSGFSTNLNTAQVLVMSLWDDHTANMLWLDSTYPTDSTKTGASRGPCAVLSGVPKNVESQHGDATVIYSDIKFGAINSTFSYN

SEQ ID NO: 139 - protein, 448 aa, Unknown
  source: /note="Description of Unknown: Uncultured symbiotic protist of Cryptocercus punctulatus"
MFLALFVLGKSLGIATNQAENHPKLTWTRYQSKGSGQTVNGEVVLDSNWRWTHHSGTNCYDGNTWSTSLCPDPQTCSSNCDLDGADYPGTYGISSSGNSLKLGFVTHGSYSTNIGSRVYLLRDSKNYEMFKLKNKEFTFTVDDSKLPCGLNGALYFVAMEEDGGVAKNSINKAGAQYGTGYCDAQCPHDMKFINGEANVLDWKPQSNDENSGNGRYGACCIEMDIWEANSMATAYTPHVCTVTGIHRCEGTECGDTDANQRYNGICDKDGCDFNSYRMGDKSFFGVGKTVDSSKPVTVVTQFVTSNGQDGGTLSEIKRKYVQGGKVIENSKVNIAGITAVNSITDTFCNEQKKAFGDNNDFEKKGGLGALSKQLDLGMVLVLSLWDDHSVNMLWLDSTYPTDAAAGALGTERGACATSSGKPSDVESQSPDASVTFSDIKFGPIDSTY

SEQ ID NO: 140 - protein, 441 aa, Unknown
  source: /note="Description of Unknown: Uncultured symbiotic protist of Neotermes koshunensis"
MLLCLLSIANSLGVGTNTAENHPKLSWKNGGSSVSGSVTVDANWRWTHIKGETKNCYDGNLWSDKYCPDAATCGKNCVIEGADYQGTYGVSSSGDGLTLTFVTHGQYSTNVGSRLYLMKDEKTYQMFNLNGKEFTFTVDVSNLPCGLNGALYFVQMDSDGGMAKYPDNQAGAKYGTGYCDAQCPTDLKFINGIPNSDGWKPQKNDKNSGNGKYGSCCSEMDIWEANSQATAYTPHVCDKLEQTRCSGSSCGHTGGGERFSSSCDPDGCDFNSWRMGNKTFWGPGLIVDTKKPVQVVTQFVGSGNSCTEIKRKYVQGGKVIDNSMSNIAGMSKQYNSVSDDFCQAQKKAFGDNDSFTKHGGFRQLGATLGKGHVLVLSLWDDHDVNMLWLDSVYPTNSNKPGSDRGPCKTSSGIPADVESQAASSSVKYSDIRFGAIDSTYK

SEQ ID NO: 141 - protein, 439 aa, Unknown
  source: /note="Description of Unknown: Uncultured symbiotic protist of Mastotermes darwiniensis"
MLCIGLISFVYSLGVGTNTAETHPKLTWKNGGQTVNGEVTVDSNWRWTHTKGSTKNCYDGNLWSKDLCPDAATCGKNCVLEGADYSGTYGVTSSGNALTLKFVTHGSYSTNVGSRLYLMKDEKTYQMFNLNGKEFTFTVDVSNLPCGLNGALYHVNMDEDGGTKRYPDNEAGAKYGTGYCDAQCPTDLKFINGIPNSDGWKPQSNDKNSGNGKYGSCCSEMDIWEANSICSAVTPHVCDTLQQTRCQGTACGENGGGSRFGSSCDPDGCDFNSWRMGNKTFYGPGLIVDTKSKFTVVTQFVGSPVTEIKRKYVQNGKVIENSFSNIEGMDKFNSISDKFCTAQKKAFGDTDSFTKHGGFKQLGSALAKGMVLVLSLWDDHTVNMLWLDSVYPTNSKKAGSDRGPCPTTSGVPADVESKSANANVIYSDIRFGAIDSTYK

SEQ ID NO: 142 - protein, 441 aa, Unknown
  source: /note="Description of Unknown: Uncultured symbiotic protist of Neotermes koshunensis"
MLLCLLGIASSLDAGTNTAENHPQLSWKNGGSSVSGSVTVDANWRWTHIKGETKNCYDGNLWSDKYCPDAATCGQNCVIEGADYQGTYGVSASGNALTLTFVTHGQYSTNVGSRLYLLKDEKTYQIFNLIGKEFTFTVDVSNLPCGLNGALYFVQMDADGGTAKYSDNKAGAKYGTGYCDAQCPTDLKFINGIPNSDGWKPQKNDKNSGNGRYGSCCSEMDVWEANSLATAYTPHVCDKLEQVRCDGRACGQNGGGDRFSSSCDPDGCDFNSWRLGNKTFWGPGLIVDTKQPVQVVTQWVGSGTSVTEIKRKYVQGGKVIDNSFTKLDSLTKQYNSVSDEFCVAQKKAFGDNDSFTKHGGFRQLGATLAKGHVLVLSLWDDHDVNMLWLDSVYPTNSNKPGADRGPCKTSSGVPADVESQAASSSVKYSDIRFGAIDSTYK

SEQ ID NO: 143 - protein, 439 aa, Unknown
  source: /note="Description of Unknown: Uncultured symbiotic protist of Mastotermes darwiniensis"
MLGIGFVCIVYSLGVGTNTAENHPKLTWKNSGSTTNGEVTVDSNWRWTHTKGTTKNCYDGNLWSKDLCPDAATCGKNCVLEGADYSGTYGVTSSGDALTLKFVTHGSYSTNVGSRLYLLKDEKTYQIFNLNGKEFTFTVDVSNLPCGLNGALYFVNMDADGGTGRYPDNQAGAKYGTGYCDAQCPTDLKFINGIPNSDGWKPQSNDKNSGNGKYGSCCSEMDIWEANSLATAVTPHVCDQVGQTRCEGRACGENGGGDRFGSSCDPDGCDFNSWRLGNKTFWGPGLIVDTKKPVTVVTQFVGSPVTEIKRKYVQGGKVIENSYTNIEGLDKFNSISDKFCTAQKKAFGDNDSFIKHGGFRQLGQSFTKGQVLVLSLWDDHTVNMLWLDSVYPTNSKKPGADRGPCPTSSGVPADVESKNAGSSVKYSDIRFGSIDSTYK

SEQ ID NO: 144 - protein, 438 aa, Unknown
  source: /note="Description of Unknown: Uncultured symbiotic protist of Reticulitermes speratus"
MATLVGILVSLFALEVALEIGTQTSESHPSLSWELNGQRQTGSIVIDSNWRWLHDSGTTNCYDGNEWSSDLCPDPEKCSQNCYLEGADYSGTYGISSSGNSLQLGFVTKGSYSTNIGSRVYLLKDENTYATFKLKNKEFTFTADVSNLPCGLNGALYFVAMPADGGKSKYPLAKPGAKYGMGYCDAQCPHDMKFINGEANILDWKPSSNDENAGAGRYGTCCTEMDIWEANSQATAYTVHACSKNARCEGTECGDDDGRYNGICDKDGCDFNSWRWGNKTFFGPNLIVDSSKPVTVVTQFIGDPLTEIRRIYVQGGKVIQNSFTNISGVASVDSITDAFCNENKVATGDTNDFKAKGGMSGFSKALDTEVVLVLSLWDDHTANMLWLDSTYPTDSSALGASRGPCAITSGEPKDVESASANASVKFSDIKFGAIDSTY

SEQ ID NO: 145 - protein, 441 aa, Unknown
  source: /note="Description of Unknown: Uncultured symbiotic protist of Reticulitermes speratus"
MLTLVYFLLSLVVSLEIGTQQSESHPQLSWQNGSSSVSGSIVLDSNWRWVHDSGTTNCYDGNLWSTDLCPSSDTCTSKCYIEGADYSGTYGITSSGSKLTLKFVTKGSYSTNIGSRVYLLKDENTYETFKLKNKEFTFTVDDSKLDCGLNGALYFVAMDADGGKAKYSSFKPGAKYGMGYCDAQCPHDMKFISGKANVDDWKPQDNDENSGNGKLGTCCSEMDIWEGNAKSQAYTVHACTKSGQYECTGQQCGDTDSGDRFKGTCDKDGCDYASWRWGDQSFYGEGKTVDTKQPLTVVTQFVGDPLTEIRRVYVQGGKTINNSKTSNLADTYDSITDKFCDATKEASGDTNDFKAKGAMSGFSTNLNTAQVLVMSLWDDHTANMLWLDSTYPTDSTKTGASRGPCAVSSGVPKDVESQHGDATVIYSDIKFGAINSTFKWN

SEQ ID NO: 146 - protein, 446 aa, Unknown
  source: /note="Description of Unknown: Uncultured symbiotic protist of Hodotermopsis sjoestedti"
MLSLVSIFLVGLGFSLGVGTQQSESHPSLSWQNCSAKGSCQSVSGSIVLDSNWRWLHDSGTTNCYDGNEWSTDLCPDASTCDKNCYIEGADYSGTYGITSSGAQLKLGFVTKGSYSTNIGSRVYLLRDESHYQLFKLKNHEFTFTVDDSQLPCGLNGALYFVEMAEDGGAKPGAQYGMGYCDAQCPHDMKFITGEANVKDWKPQETDENAGNGHYGACCTEMDIWEANSQATAYTPHICSKTGIYRCEGTECGDNDANQRYNGVCDKDGCDFNSYRLGNKTFWGPGLTVDSNKAMIVVTQFTTSNNQDSGELSEIRRIYVQGGKTIQNSDTNVQGITTTNKITQAFCDETKVTFGDTNDFKAKGGFSGLSKSLESGAVLVLSLWDDHSVNMLWLDSTYPTDSAGKPGADRGPCAITSGDPKDVESQSPNASVTFSDIKFGPIDSTY

SEQ ID NO: 147 - protein, 448 aa, Unknown
  source: /note="Description of Unknown: Uncultured symbiotic protist of Cryptocercus punctulatus"
MILALLVLGKSLGIATNQAETHPKLTWTRYQSKGSGSTVNGEIVLDSNWRWTHHSGTNCYDGNTWSTSLCPDPTTCSNNCDLDGADYPGTYGISTSGNSLKLGFVTHGSYSTNIGSRVYLLKDTKSYEMFKLKNKEFTFTVDDSKLPCGLNGALYFVAMDEDGGVSKNSINKAGAQYGTGYCDAQCPHDMKFINGEANVLDWKPQSNDENSGNGRYGACCTEMDIWEANSMATAYTPHVCTVTGLRRCEGTECGDTDNDQRYNGICDKDGCDFNSYRLGDKSFFGVGKTVDSSKPVTVVTQFVTSNGQDSGTLSEIRRKYVQGGKVIENSKVNVAGITAGNSVTDTFCNEQKKAFGDNNDFEKKGGFGALSKQLVAGMVLVLSLWDDHSVNMLWLDSTYPTNAAAGALGTERGACATSSGKPSDVESQSPDATVTFSDIKFGPIDSTY

SEQ ID NO: 148 - protein, 445 aa, Unknown
  source: /note="Description of Unknown: Uncultured symbiotic protist of Mastotermes darwiniensis"
MLCVGLFGLVYSIGVGTNTQETHPKLSWKQCSSGGSCTTQQGSVVIDSNWRWTHSTKDLTNCYDGNLWDSTLCPDGTTCSKNCVLEGADYSGTYGITSSGDSLTLKFVTHGSYSTNVGSRLYLLKDDNNYQIFNLAGKEFTFTVDVSNLPCGLNGALYFVEMDQDGGKGKHKENEAGAKYGTGYCDAQCPTDLKFIDGIANSDGWKPQDNDENSGNGKYGSCCSEMDIWEANSLATAYTPHVCDTKGQKRCQGTACGENGGGDRFGSECDPDGCDFNSWRQGNKSFWGPGLIIDTKKSVQVVTQFIGSGSSVTEIRRKYVQNGKVIENSYSTISGTEKYNSISDDYCNAQKKAFGDTNSFENHGGFKRFSQHIQDMVLVLSLWDDHTVNMLWLDSVYPTNSNKPGADRGPCETSSGVPADVESKSASASVKYSDIRFGPIDSTYK

SEQ ID NO: 149 - protein, 441 aa, Unknown
  source: /note="Description of Unknown: Uncultured symbiotic protist of Neotermes koshunensis"
MLLCLWSIAYSLGVGTNTAENHPKLSWKNGGSSVSGSVTVDANWRWTHIKGETKNCYDGNLWSDKYCPDAATCGKNCVIEGADYQGTYGVSASGDGLTLTFVTHGQYSTNVGSRLYLMKDEKTYQIFNLNGKEFTFTVDVSNLPCGLNGALYFVQMDSDGGMAKYPDNQAGAKYGTGYCDAQCPTDLKFINGIPNSDGWKPQKNDKNSGNGKYGSCCSEMDIWEANSQATAYTPHVCDKLEQTRCSGSACGHTGGGERFSSSCDPDGCDFNSWRMGNKTFWGPGLIVDTKKPVQVVTQFVGSGNSCTEIKRKYVQGGKVIDNSMSNIAGMTKQYNSVSDDFCQAQKKAFGDNDSFTKHGGFRQLGATLGKGHVLVLSLWDDHDVNMLWLDSVYPTNSNKPGSDRGPCKTSSGIPADVESQAASSSVKYSDIRFGAIDSTYK

SEQ ID NO: 150 - protein, 33 aa, Unknown
  source: /note="Description of Unknown: Variant CBH I polypeptide sequence"
NVEGWTPSSNNANTGLGNHGACCAELDIWEANS

SEQ ID NO: 151 - protein, 33 aa, Trichoderma reesei
NVEGWTPSANNANTGIGNHGACCAELDIWEANS

SEQ ID NO: 152 - protein, 33 aa, Penicillium occitanis
NVEGWEPSSNNANTGIGGHGSCCSEMDIWEANS

SEQ ID NO: 153 - protein, 33 aa, Trichoderma reesei
NVEGWEPSSNNANTGIGGHGSCCSEMDIWQANS

SEQ ID NO: 154 - protein, 33 aa, Aspergillus nidulans
NVEGWESSDTNPNGGVGNHGSCCAEMDIWEANS

SEQ ID NO: 155 - protein, 33 aa, Gibberella zeae
NSDGWQPSDSDVNGGIGNLGTCCPEMDIWEANS

SEQ ID NO: 156 - protein, 33 aa, Aspergillus fumigatus
NVEGWQPSSNDANAGTGNHGSCCAEMDIWEANS

SEQ ID NO: 157 - protein, 33 aa, Aspergillus clavatus
NVEGWTPSSSDANAGNGGHGSCCAEMDIWEANS

SEQ ID NO: 158 - protein, 33 aa, Claviceps purpurea
NSKDWIPSKSDANAGIGSLGACCREMDIWEANN

SEQ ID NO: 159 - protein, 31 aa, Phanerochaete chrysosporium
NVGNWTETGSNTGTGSYGTCCSEMDIWEANN

SEQ ID NO: 160 - protein, 33 aa, Neosartorya fischeri
NVEGWKPSSNDKNAGVGGHGSCCPEMDIWEANS

SEQ ID NO: 161 - protein, 33 aa, Leptosphaeria maculans
NVEGWQPSKNDQNAGVGGHGSCCAEMDIWEANS

SEQ ID NO: 162 - protein, 33 aa, Neurospora crassa
NVEGWTPSTNDANAGIGDHGTCCSEMDIWEANK

SEQ ID NO: 163 - protein, 33 aa, Coprinopsis cinerea
NSADWTPSETDPNAGRGRYGICCAEMDIWEANS

SEQ ID NO: 164 - protein, 33 aa, Botryotinia fuckeliana
NVEGWVPDSNSANSGTGNIGSCCSEFDVWEANS

SEQ ID NO: 165 - protein, 33 aa, Phaeosphaeria nodorum
NADGWQASTSDPNAGVGKKGACCAEMDVWEANS

SEQ ID NO: 166 - protein, 33 aa, Humicola grisea
NIEGWRPSTNDPNAGVGPMGACCAEIDVWESNA

SEQ ID NO: 167 - protein, 33 aa, Humicola grisea
NIEGWTGSTNDPNAGAGRYGTCCSEMDIWEANN

SEQ ID NO: 168 - protein, 33 aa, Chaetomium thermophilum
NIEGWRPSTNDANAGVGPYGACCAEIDVWESNA

SEQ ID NO: 169 - protein, 33 aa, Chaetomium thermophilum
NIENWTPSTNDANAGFGRYGSCCSEMDIWEANN

SEQ ID NO: 170 - protein, 33 aa, Phaeosphaeria nodorum
NVEGWKPSDNDANAGVGGHGSCCAEMDIWEANS

SEQ ID NO: 171 - protein, 33 aa, Coprinopsis cinerea
NSVGWEPSETDSNAGRGRYGICCAEMDIWEANS

SEQ ID NO: 172 - protein, 33 aa, Agaricus bisporus
NSEGWEGSPNDVNAGTGNFGACCGEMDIWEANS

SEQ ID NO: 173 - protein, 33 aa, Phaeosphaeria nodorum
NVEGWNPSDADPNAGSGKIGACCPEMDIWEANS

SEQ ID NO: 174 - protein, 31 aa, Phanerochaete chrysosporium
NVQGWNATSATTGTGSYGSCCTELDIWEANS

SEQ ID NO: 175 - protein, 33 aa, Aspergillus fumigatus
NVEGWEPSSSDKNAGVGGHGSCCPEMDIWEANS

SEQ ID NO: 176 - protein, 31 aa, Phanerochaete chrysosporium
NVEGWNATSANAGTGNYGTCCTEMDIWEANN

SEQ ID NO: 177 - protein, 33 aa, Thermoascus aurantiacus
NVEGWQPSANDPNAGVGNHGSSCAEMDVWEANS

SEQ ID NO: 178 - protein, 33 aa, Humicola grisea; identical to SEQ ID NO: 166

SEQ ID NO: 179 - protein, 33 aa, Trichoderma viride; identical to SEQ ID NO: 152

SEQ ID NO: 180 - protein, 33 aa, Thermoascus aurantiacus
NVEGWQPSANDPNAGVGNHGSCCAEMDVWEANS

SEQ ID NO: 181 - protein, 33 aa, Magnaporthe grisea
NVEGWQPSSGDANSGVGNMGSCCAEMDIWEANS

SEQ ID NO: 182 - protein, 33 aa, Talaromyces emersonii
NVEGWQPSSNNANTGIGDHGSCCAEMDVWEANS

SEQ ID NO: 183 - protein, 32 aa, Aspergillus oryzae
RKGWEPSDSDKNAGVGGHGSCCPQMDIWEANS

SEQ ID NO: 184 - protein, 33 aa, Penicillium chrysogenum
NVEGWEPSSSDVNGGTGNYGSCCAEMDIWEANS

SEQ ID NO: 185 - protein, 33 aa, Podospora anserina
NIEGWNPSTNDVNAGAGRYGTCCSEMDIWEANN

SEQ ID NO: 186 - protein, 33 aa, Pleurotus sp.
NVQGWQPSPNDSNAGKGQYGSCCAEMDIWEANS

SEQ ID NO: 187 - protein, 33 aa, Gibberella zeae; identical to SEQ ID NO: 155

SEQ ID NO: 188 - protein, 33 aa, Sclerotinia sclerotiorum
NNEGWVPDSNSANSGTGNIGSCCSEFDVWEANS

SEQ ID NO: 189 - protein, 31 aa, Phanerochaete chrysosporium; identical to SEQ ID NO: 159

SEQ ID NO: 190 - protein, 33 aa, Trichoderma reesei; identical to SEQ ID NO: 152

SEQ ID NO: 191 - protein, 33 aa, Aspergillus terreus
NVEGWEPSANDANAGTGNHGSCCAEMDIWEANS

SEQ ID NO: 192 - protein, 33 aa, Botryotinia fuckeliana
NSVGWTPSSNDVNAGAGQYGSCCSEMDIWEANK

SEQ ID NO: 193 - protein, 33 aa, Volvariella volvacea
NVQGWQPSPNDTNAGTGNYGACCNEMDVWEANS

SEQ ID NO: 194 - protein, 33 aa, Penicillium janthinellum
NVDGWTPSKNDVNSGIGNHGSCCAEMDIWEANS

SEQ ID NO: 195 - protein, 33 aa, Pleurotus sp.
NILDWSASATDANAGNGRYGACCAEMDIWEANS

SEQ ID NO: 196 - protein, 33 aa, Aspergillus nidulans
NVEGWEPSDSDANAGVGGMGTCCPEMDIWEANS

SEQ ID NO: 197 - protein, 33 aa, Fusarium poae
NSDGWEPSKSDVNGGIGNLGTCCPEMDIWEANS

SEQ ID NO: 198 - protein, 33 aa, Pleurotus sp.
NILDWSGSATDPNAGNGRYGACCAEMDIWEANS

SEQ ID NO: 199 - protein, 33 aa, Trichoderma viride; identical to SEQ ID NO: 152

SEQ ID NO: 200 - protein, 33 aa, Alternaria alternata
NVEGWKPSSNDANAGVGGHGSCCAEMDIWEANS

SEQ ID NO: 201 - protein, 33 aa, Neosartorya fischeri
NVEGWTPSSNNENTGLGNYGSCCAELDIWESNS

SEQ ID NO: 202 - protein, 33 aa, Neurospora crassa
NIEGWTPSTNDANAGVGPYGGCCAEIDVWESNA

SEQ ID NO: 203 - protein, 33 aa, Cryphonectria parasitica
NVEGWTPSTNDANAGVGGLGSCCSEMDVWEANS

SEQ ID NO: 204 - protein, 31 aa, Corticium rolfsii
NLLDWNATSANSGTGSYGSCCPEMDIWEANK

SEQ ID NO: 205 - protein, 33 aa, Magnaporthe grisea
NIEGWQPSSTDSSAGIGAQGACCAEIDIWESNK

SEQ ID NO: 206 - protein, 33 aa, Magnaporthe grisea
NIEGWKPSSNDANAGVGPYGACCAEIDVWESNA

SEQ ID NO: 207 - protein, 33 aa, Fusarium oxysporum
NSEGWKPSDSDVNAGVGNLGTCCPEMDIWEANS

SEQ ID NO: 208 - protein, 33 aa, Aspergillus clavatus
NVEGWKPSDNDKNAGVGGYGSCCPEMDIWEANS

SEQ ID NO: 209 - protein, 33 aa, Penicillium funiculosum
NVEGWTPSTNNSNTGIGNHGSCCAELDIWEANS

SEQ ID NO: 210 - protein, 33 aa, Humicola grisea; identical to SEQ ID NO: 167

SEQ ID NO: 211 - protein, 33 aa, Chaetomium thermophilum
NVGNWTPSTNDANAGFGRYGSCCSEMDVWEANN

SEQ ID NO: 212 - protein, 33 aa, Aspergillus oryzae
NVEGWVSSTNNANTGTGNHGSCCAELDIWESNS

SEQ ID NO: 213 - protein, 33 aa, Gibberella pulicaris
NSDGWQPSKSDVNAGIGNMGTCCPEMDIWEANS

SEQ ID NO: 214 - protein, 33 aa, Volvariella volvacea
NVAGWNGSPNDTNAGTGNWGACCNEMDIWEANS

SEQ ID NO: 215 - protein, 33 aa, Irpex lacteus
NVAGWTGSSSDPNSGTGNYGTCCSEMDIWEANS

SEQ ID NO: 216 - protein, 33 aa, Chaetomium thermophilum; identical to SEQ ID NO: 169

SEQ ID NO: 217 - protein, 33 aa, Irpex lacteus
NIVDWTASAGDANSGTGSFGTCCQEMDIWEANS

SEQ ID NO: 218 - protein, 31 aa, Phanerochaete chrysosporium; identical to SEQ ID NO: 159

SEQ ID NO: 219 - protein, 33 aa, Melanocarpus albomyces
NIEGWKSSTSDPNAGVGPYGSCCAEIDVWESNA

SEQ ID NO: 220 - protein, 31 aa, Podospora anserina
NVEGWGGADGNSGTGKYGICCAEMDIWEANS

SEQ ID NO: 221 - protein, 33 aa, Cochliobolus carbonum
NVEGWNPSDADPNGGAGKIGACCPEMDIWEANS

SEQ ID NO: 222 - protein, 33 aa, Trichoderma viride; identical to SEQ ID NO: 152

SEQ ID NO: 223 - protein, 33 aa, Aspergillus aculeatus
NIEGWEPSSTDVNAGTGNHGSCCPEMDIWEANS

SEQ ID NO: 224 - protein, 33 aa, Dictyostelium discoideum
NVDGWIPSTNNPNTGYGNLGSCCAEMDLWEANN

SEQ ID NO: 225 - protein, 33 aa, Sclerotinia sclerotiorum
NSVGWTPSSNDVNTGTGQYGSCCSEMDIWEANK

SEQ ID NO: 226 - protein, 31 aa, Chaetomium globosum
NSEGWGGEDGNSGTGKYGTCCAEMDIWEANL

SEQ ID NO: 227 - protein, 33 aa, Aspergillus niger
NCDGWEPSSNNVNTGVGDHGSCCAEMDVWEANS

SEQ ID NO: 228 - protein, 33 aa, Nectria haematococca
NSDEWKPSDSDKNAGVGKYGTCCPEMDIWEANK

SEQ ID NO: 229 - protein, 33 aa, Talaromyces emersonii; identical to SEQ ID NO: 182

SEQ ID NO: 230 - protein, 33 aa, Polyporus arcularius
NVLDWAGSSNDPNAGTGHYGTCCNEMDIWEANS

SEQ ID NO: 231 - protein, 33 aa, Leptosphaeria maculans
NAEGWTKSASDPNSGVGKKGACCAQMDVWEANS

SEQ ID NO: 232 - protein, 31 aa, Phanerochaete chrysosporium; identical to SEQ ID NO: 176

SEQ ID NO: 233 - protein, 33 aa, Penicillium decumbens
NVEGWKPSANDKNAGVGPHGSCCAEMDIWEANS

SEQ ID NO: 234 - protein, 33 aa, Sclerotinia sclerotiorum
NVDGWVPSSNNPNTGVGNYGSCCAEMDIWEANS

SEQ ID NO: 235 - protein, 33 aa, Acremonium thermophilum
NIDGWQPSSNDANAGLGNHGSCCSEMDIWEANK

SEQ ID NO: 236 - protein, 33 aa, Aspergillus nidulans; identical to SEQ ID NO: 196

SEQ ID NO: 237 - protein, 33 aa, Podospora anserine
NIEGWRESSNDENAGVGPYGGCCAEIDVWESNA

SEQ ID NO: 238 - protein, 33 aa, Thermoascus aurantiacus; identical to SEQ ID NO: 180

SEQ ID NO: 239 - protein, 33 aa, Pseudotrichonympha grassii
NVENWKPQTNDENAGNGRYGACCTEMDIWEANK

SEQ ID NO: 240 - protein, 33 aa, Aspergillus terreus
NVEGWTPSDNDKNAGVGGHGSCCPELDIWEANS

SEQ ID NO: 241 - protein, 31 aa, Phanerochaete chrysosporium; identical to SEQ ID NO: 159

SEQ ID NO: 242 - protein, 31 aa, Phanerochaete chrysosporium
NVEGWLGTTATTGTGFFGSCCTDIALWEAND

SEQ ID NO: 243 - protein, 33 aa, Thermoascus aurantiacus; identical to SEQ ID NO: 177

SEQ ID NO: 244 - protein, 33 aa, Acremonium thermophilum
NSASWQPSSNDQNAGVGGMGSCCAEMDIWEANS

SEQ ID NO: 245 - protein, 33 aa, Volvariella volvacea
NVQGWQPSPNDTNAGTGNYGACCNKMDVWEANS

SEQ ID NO: 246 - protein, 33 aa, Chaetomium globosum
NYDGWTPSSNDANAGVGALGGCCAEIDVWESNA

SEQ ID NO: 247 - protein, 33 aa, Irpex lacteus
NVAGWAGSASDPNAGSGTLGTCCSEMDIWEANN

SEQ ID NO: 248 - protein, 33 aa, Lentinula edodes
NVEGWTPSSTSPNAGTGGTGICCNEMDIWEANS

SEQ ID NO: 249 - protein, 33 aa, Pleurotus sp.
NVLDWSASATDDNAGNGRYGACCAEMDIWEANS

SEQ ID NO: 250 - protein, 33 aa, Fusarium venenatum
NSDGWQPSKSDVNGGIGNLGTCCPEMDIWEANS

SEQ ID NO: 251 - protein, 31 aa, Phanerochaete chrysosporium; identical to SEQ ID NO: 176

SEQ ID NO: 252 - protein, 33 aa, Fusicoccum sp.
NVQNWTASSTDKNAGTGHYGSCCNEMDIWEANS

SEQ ID NO: 253 - protein, 33 aa, Coprinopsis cinerea
NSVGWEPSETDPNAGKGQYGICCAEMDIWEANS

SEQ ID NO: 254 - protein, 33 aa, Trichoderma harzianum
NVEGWEPSSNNANTGVGGHGSCCSEMDIWEANS

SEQ ID NO: 255 - protein, 32 aa, Neurospora crassa
NVEGWTPSTNDANGIGDHGSCCSEMDIWEANK

SEQ ID NO: 256 - protein, 33 aa, Neosartorya fischeri; identical to SEQ ID NO: 156

SEQ ID NO: 257 - protein, 33 aa, Chaetomium thermophilum; identical to SEQ ID NO: 168

SEQ ID NO: 258 - protein, 33 aa, Botryotinia fuckeliana
NVDGWVPSSNNANTGVGNHGSCCAEMDIWEANS

SEQ ID NO: 259 - protein, 33 aa, Pseudotrichonympha grassii; identical to SEQ ID NO: 239

SEQ ID NO: 260 - protein, 33 aa, Irpex lacteus
NVEGWTGSSTDSNSGTGNYGTCCSEMDIWEANS

SEQ ID NO: 261 - protein, 33 aa, Gibberella avenacea
NSDGWKPSDSDINAGIGNMGTCCPEMDIWEANS

SEQ ID NO: 262 - protein, 33 aa, Aspergillus niger; identical to SEQ ID NO: 227

SEQ ID NO: 263 - protein, 33 aa, Aspergillus niger
NVDGWEPSSNNDNTGIGNHGSCCPEMDIWEANK

SEQ ID NO: 264 - protein, 33 aa, Chrysosporium lucknowense
NVENWQSSTNDANAGTGKYGSCCSEMDVWEANN

SEQ ID NO: 265 - protein, 33 aa, Thielavia australiensis
NVEGWESSTNDANAGSGKYGSCCTEMDVWEANN

SEQ ID NO: 266 - protein, 33 aa, Unknown
  source: /note="Description of Unknown: Uncultured symbiotic protist of Reticulitermes speratus"
NVDDWKPQDNDENSGNGKLGTCCSEMDIWEGNM

SEQ ID NO: 267 - protein, 33 aa, Unknown
  source: /note="Description of Unknown: Uncultured symbiotic protist of Neotermes koshunensis"
NSEGWKPQSGDKNAGNGKYGSCCSEMDVWESNS

SEQ ID NO: 268 - protein, 33 aa, Unknown; identical to SEQ ID NO: 266
  source: /note="Description of Unknown: Uncultured symbiotic protist of Reticulitermes speratus"

SEQ ID NO: 269 - protein, 33 aa, Unknown
  source: /note="Description of Unknown: Uncultured symbiotic protist of Cryptocercus punctulatus"
NVLDWKPQSNDENSGNGRYGACCTEMDIWEANS

SEQ ID NO: 270 - protein, 33 aa, Unknown
  source: /note="Description of Unknown: Uncultured symbiotic protist of Hodotermopsis sjoestedti"
NVEGWKPSDNDENAGTGKWGACCTEMDIWEANK

SEQ ID NO: 271 - protein, 33 aa, Unknown; identical to SEQ ID NO: 269
  source: /note="Description of Unknown: Uncultured symbiotic protist of Cryptocercus punctulatus"

SEQ ID NO: 272 - protein, 33 aa, Unknown
  source: /note="Description of Unknown: Uncultured symbiotic protist of Reticulitermes speratus"
NVDDWKPQDNDENSGDGKLGTCCSEMDIWEGNA

SEQ ID NO: 273 - protein, 33 aa, Unknown; identical to SEQ ID NO: 269
  source: /note="Description of Unknown: Uncultured symbiotic protist of Cryptocercus punctulatus"

SEQ ID NO: 274 - protein, 33 aa, Unknown
  source: /note="Description of Unknown: Uncultured symbiotic protist of Mastotermes darwiniensis"
NSDGWKPQSNDKNSGNGKYGSCCSEMDIWEANS

SEQ ID NO: 275 - protein, 33 aa, Unknown
  source: /note="Description of Unknown: Uncultured symbiotic protist of Neotermes koshunensis"
NSDGWKPQKNDKNSGNGKYGSCCSEMDIWEANS

SEQ ID NO: 276 - protein, 33 aa, Unknown; identical to SEQ ID NO: 267
  source: /note="Description of Unknown: Uncultured symbiotic protist of Neotermes koshunensis"

SEQ ID NO: 277 - protein, 33 aa, Unknown
  source: /note="Description of Unknown: Uncultured symbiotic protist of Reticulitermes speratus"
NVLDWKPQSNDENAGTGRYGTCCTEMDIWEANS

SEQ ID NO: 278 - protein, 33 aa, Unknown
  source: /note="Description of Unknown: Uncultured symbiotic protist of Cryptocercus punctulatus"
NVLDWKPQSNDENSGNGRWGARCTEMDIWEANS

SEQ ID NO: 279 - protein, 33 aa, Unknown; identical to SEQ ID NO: 274
  source: /note="Description of Unknown: Uncultured symbiotic protist of Mastotermes darwiniensis"

SEQ ID NO: 280 - protein, 33 aa, Unknown; identical to SEQ ID NO: 269
  source: /note="Description of Unknown: Uncultured symbiotic protist of Cryptocercus punctulatus"

SEQ ID NO: 281 - protein, 33 aa, Unknown
  source: /note="Description of Unknown: Uncultured symbiotic protist of Hodotermopsis sjoestedti"
NVQDWKPSDNDDNAGTGHYGACCTEMDIWEANK

SEQ ID NO: 282 - protein, 33 aa, Unknown; identical to SEQ ID NO: 274
  source: /note="Description of Unknown: Uncultured symbiotic protist of Mastotermes darwiniensis"

SEQ ID NO: 283 - protein, 33 aa, Unknown
  source: /note="Description of Unknown: Uncultured symbiotic protist of Reticulitermes speratus"
NVLDWKPQETDENSGNGRYGTCCTEMDIWEANS

SEQ ID NO: 284 - protein, 33 aa, Unknown
  source: /note="Description of Unknown: Uncultured symbiotic protist of Reticulitermes speratus"
NVEDWKPQDNDENSGNGKLGTCCSEMDIWEGNA

SEQ ID NO: 285 - protein, 33 aa, Unknown; identical to SEQ ID NO: 277
  source: /note="Description of Unknown: Uncultured symbiotic protist of Reticulitermes speratus"

SEQ ID NO: 286 - protein, 33 aa, Unknown
  source: /note="Description of Unknown: Uncultured symbiotic protist of Reticulitermes speratus"
NVDDWKPQDNDENSGNGKLGTCCSEMDIWEGNA

SEQ ID NO: 287 - protein, 33 aa, Unknown; identical to SEQ ID NO: 286
  source: /note="Description of Unknown: Uncultured symbiotic protist of Reticulitermes speratus"

SEQ ID NO: 288 - protein, 33 aa, Unknown
  source: /note="Description of Unknown: Uncultured symbiotic protist of Cryptocercus punctulatus"
NVLDWKPQSNDENSGNGRYGACCIEMDIWEANS

SEQ ID NO: 289 - protein, 33 aa, Unknown; identical to SEQ ID NO: 275
  source: /note="Description of Unknown: Uncultured symbiotic protist of Neotermes koshunensis"

SEQ ID NO: 290 - protein, 33 aa, Unknown; identical to SEQ ID NO: 274
  source: /note="Description of Unknown: Uncultured symbiotic protist of Mastotermes darwiniensis"

SEQ ID NO: 291 - protein, 33 aa, Unknown
  source: /note="Description of Unknown: Uncultured symbiotic protist of Neotermes koshunensis"
NSDGWKPQKNDKNSGNGRYGSCCSEMDVWEANS

SEQ ID NO: 292 - protein, 33 aa, Unknown; identical to SEQ ID NO: 274
  source: /note="Description of Unknown: Uncultured symbiotic protist of Mastotermes darwiniensis"

SEQ ID NO: 293 - protein, 33 aa, Unknown
  source: /note="Description of Unknown: Uncultured symbiotic protist of Reticulitermes speratus"
NILDWKPSSNDENAGAGRYGTCCTEMDIWEANS

SEQ ID NO: 294 - protein, 33 aa, Unknown; identical to SEQ ID NO: 286
  source: /note="Description of Unknown: Uncultured symbiotic protist of Reticulitermes speratus"

SEQ ID NO: 295 - protein, 33 aa, Unknown
  source: /note="Description of Unknown: Uncultured symbiotic protist of Hodotermopsis sjoestedti"
NVKDWKPQETDENAGNGHYGACCTEMDIWEANS

SEQ ID NO: 296 - protein, 33 aa, Unknown; identical to SEQ ID NO: 269
  source: /note="Description of Unknown: Uncultured symbiotic protist of Cryptocercus punctulatus"

SEQ ID NO: 297 - protein, 33 aa, Unknown
  source: /note="Description of Unknown: Uncultured symbiotic protist of Mastotermes darwiniensis"
NSDGWKPQDNDENSGNGKYGSCCSEMDIWEANS

SEQ ID NO: 298 - protein, 33 aa, Unknown; identical to SEQ ID NO: 275
  source: /note="Description of Unknown: Uncultured symbiotic protist of Neotermes koshunensis"

SEQ ID NO: 299 - protein, 497 aa, Unknown
  source: /note="Description of Unknown: Variant CBH I polypeptide sequence"
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNAYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 300 - protein, 497 aa, Unknown
  source: /note="Description of Unknown: Variant CBH I polypeptide sequence"
QSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVAGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 301 - protein, 529 aa, Unknown
  source: /note="Description of Unknown: Variant CBH I polypeptide sequence"
MSALNSFNMYKSALILGSLLATAGAQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSSNNANTGLGNHGACCAELDIWEANSISEALTPHPCDTPGLSVCTTDACGGTYSSDKYAGTCDPDGCDFNPYRLGVTDFYGSGKTVDTTKPITVVTQFVTDDGTSTGTLSEIRRYYVQNGVVIPQPSSKISGVSGNVINSDFCDAEISTFGETASFSKHGGLAKMGAGMEAGMVLVMSLWDDYSVNMLWLDSTYPTNATGTPGAAKGSCPTTSGDPKTVESQSGSSYVTFSDIRVGPFNSTFSGGSSTGGSSTTTASGTTTTKASSTSTSSTSTGTGVAAHWGQCGGQGWTGPTTCASGTTCTVVNPYYSQCL

SEQ ID NO: 302 - protein, 504 aa, Unknown
  source: /note="Description of Unknown: Variant CBH I polypeptide sequence"
QQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSSNNANTGLGNHGACCAELDIWEANSISEALTPHPCDTPGLSVCTTDACGGTYSSDKYAGTCDPDGCDFNPYRLGVTDFYGSGKTVDTTKPITVVTQFVTDDGTSTGTLSEIRRYYVQNGVVIPQPSSKISGVSGNVINSDFCDAEISTFGETASFSKHGGLAKMGAGMEAGMVLVMSLWDDYSVNMLWLDSTYPTNATGTPGAAKGSCPTTSGDPKTVESQSGSSYVTFSDIRVGPFNSTFSGGSSTGGSSTTTASGTTTTKASSTSTSSTSTGTGVAAHWGQCGGQGWTGPTTCASGTTCTVVNPYYSQCL

What is claimed is:

1. A polypeptide comprising a variant cellobiohydrolase I (CBH I) catalytic domain as compared to a reference CBH I catalytic domain, wherein the variant CBH I catalytic domain comprises an amino acid sequence having at least 90% sequence identity to amino acids 26-455 of SEQ ID NO:1, the polypeptide comprising:
  (a) a substitution at the amino acid position corresponding to R268 of *T. reesei* CBH I of SEQ ID NO:2 (R268 substitution);
  (b) a substitution at the amino acid position corresponding to R411 of *T. reesei* CBH I of SEQ ID NO: 2 (R411 substitution); or
  (c) both an R268 substitution and an R411 substitution,
  wherein substitution (a), (b) or (c) decreases product inhibition as compared to the reference CBH I catalytic domain.

2. The polypeptide of claim 1, which comprises an R268 substitution.

3. The polypeptide of claim 2, wherein the R268 substituent is a lysine.

4. The polypeptide of claim 2, wherein the R268 substituent is an alanine.

5. The polypeptide of claim 1, which comprises an R411 substitution.

6. The polypeptide of claim 5, wherein the R411 substituent is a lysine.

7. The polypeptide of claim 5, wherein the R411 substituent is an alanine.

8. The polypeptide of claim 1, wherein the variant CBH I catalytic domain comprises an amino acid sequence having at least 95% sequence identity to amino acids 26-455 of SEQ ID NO:1.

9. The polypeptide of claim 8, wherein, other than said R268 and/or R411 substitutions, the variant CBH I catalytic domain comprises the sequence of amino acids 26-455 of SEQ ID NO:1.

10. The polypeptide of claim 1, wherein the variant CBH I catalytic domain comprises one of the following amino acid substitutions or pairs of amino acid substitutions as compared to a protein of SEQ ID NO:1:
  (a) R273K and R422K;
  (b) R273K and R422A;
  (c) R273A and R422K;
  (d) R273A and R422A;
  (e) R273A;
  (f) R273K;
  (g) R422A; and
  (h) R422K.

11. The polypeptide of claim 1, wherein the variant CBH I catalytic domain comprises the amino acid substitutions R273K and R422K as compared to a protein of SEQ ID NO:1.

12. The polypeptide of claim 1, wherein the variant CBH I catalytic domain does not comprise both R273K and R422K substitutions as compared to a protein of SEQ ID NO:1.

13. The polypeptide of claim 1 in which the variant CBH I catalytic domain is linked to a cellulose binding domain.

14. The polypeptide of claim 13 in which the catalytic domain is linked to a cellulose binding domain via a linker.

15. The polypeptide of claim 13 in which the cellulose binding domain is C-terminal to the catalytic domain.

16. The polypeptide of claim 13 in which the cellulose binding domain is N-terminal to the catalytic domain.

17. The polypeptide of claim 1 which further comprises a signal sequence.

18. The polypeptide of claim 1 towards which cellobiose has an $IC_{50}$ that is at least 2-fold the $IC_{50}$ of a reference CBH I lacking said R268 substitution and/or R411 substitution.

19. The polypeptide of claim 1 which CBH I activity that is at least 50% the CBH I activity of a reference CBH I lacking said R268 substitution and/or R411 substitution.

20. A composition comprising a polypeptide according to claim 1.

21. The composition of claim 20 in which said polypeptide represents at least 1% of all polypeptides in said composition.

22. The composition of claim 21 in which said polypeptide represents at least 5% of all polypeptide in said composition.

23. The composition of claim 22 in which said polypeptide represents at least 25% of all polypeptide in said composition.

24. The composition of claim 20 which is a whole cellulase.

25. The composition of claim 24, wherein the whole cellulase is produced by a host cell that recombinantly expresses said polypeptide.

26. The composition of claim 20 which is filamentous fungal whole cellulase.

27. A fermentation broth comprising a polypeptide according to claim 1.

28. The fermentation broth of claim 27, which is a filamentous fungal fermentation broth.

29. The fermentation broth of claim 27, which is a cell-free fermentation broth.

30. A method for saccharifying biomass, comprising: treating biomass with a composition according to claim 20.

31. The method of claim 30, further comprising recovering monosaccharides.

32. A nucleic acid comprising a nucleotide sequence encoding the polypeptide of claim 1.

33. A vector comprising the nucleic acid of claim 32.

34. The vector of claim 33 which further comprises an origin of replication.

35. The vector of claim 33 which further comprises a promoter sequence operably linked to said nucleotide sequence.

36. The vector of claim 35, wherein the promoter sequence is operable in yeast.

37. The vector of claim 35, wherein the promoter sequence is operable in filamentous fungi.

38. A recombinant cell engineered to express the nucleic acid of claim 32.

39. The recombinant cell of claim 38 which is a eukaryotic cell.

40. The recombinant cell of claim 39 which is a filamentous fungal cell.

41. The recombinant cell of claim 40, wherein the filamentous fungal cell is of the genus *Aspergillus, Penicillium, Rhizopus, Chrysosporium, Myceliophthora, Trichoderma, Humicola, Acremonium* or *Fusarium*.

42. The recombinant cell of claim 40, wherein the filamentous fungal cell is of the species *Aspergillus niger, Aspergillus oryzae, Trichoderma reesei, Penicillium chrysogenum, Myceliophthora thermophila,* or *Rhizopus oryzae*.

43. The recombinant cell of claim 39 which is a yeast cell.

44. The recombinant cell of claim 43 which is a yeast cell of the genus *Saccharomyces, Kluyveromyces, Candida, Pichia, Schizosaccharomyces, Hansenula, Klockera, Schwanniomyces* or *Yarrowia*.

45. The recombinant cell of claim 44, wherein the yeast cell is of the species *S. cerevisiae, S. bulderi, S. barnetti, S. exiguus, S uvarum, S. diastaticus, K lactis, K. marxianus* or *K. fragilis*.

46. The recombinant cell of claim 45, which is a *S. cerevisiae* cell.

47. A host cell transformed with the vector of claim 33.

48. The host cell of claim 47 which is a prokaryotic cell.

49. The host cell of claim 48 which is a bacterial cell.

50. The host cell of claim 47 which is a eukaryotic cell.

51. A method of producing a polypeptide according to claim 1, comprising culturing the recombinant cell engineered to express said polypeptide under conditions in which the polypeptide is expressed.

52. The method of claim 51, wherein the polypeptide comprises a signal sequence and wherein the recombinant cell is cultured under conditions in which the polypeptide is secreted from the recombinant cell.

53. The method of claim 52, further comprising recovering the polypeptide from the cell culture.

54. The method of claim 53, wherein recovering the polypeptide comprises a step of centrifuging away cells and/or cellular debris.

55. The method of claim 53, wherein recovering the polypeptide comprises a step of filtering away cells and/or cellular debris.

56. A method for generating a product tolerant variant CBH I polypeptide, wherein the variant CBH I catalytic domain comprises an amino acid sequence having at least 90% sequence identity to amino acids 26-455 of SEQ ID NO:1 comprising:
    (a) modifying the nucleotide sequence of a CBH I-encoding nucleic acid so that the nucleic acid encodes a variant CBH I polypeptide, wherein said variant CBH I polypeptide comprises:
        (i) an R273 substitution of SEQ ID NO: 1;
        (ii) an R422 substitution of SEQ ID NO: 1; or
        (iii) both an R273 substitution and an R422 substitution; and
    (b) expressing said variant CBH I polypeptide, thereby generating a product tolerant variant CBH I polypeptide.

57. A method for producing ethanol, comprising:
    (a) treating biomass with a fermentation broth according to claim 27, thereby producing monosaccharides; and
    (b) culturing a fermenting microorganism in the presence of the monosaccharides produced in step (a) under fermentation conditions, thereby producing ethanol.

* * * * *